US012565651B2

(12) United States Patent
Cheng et al.

(10) Patent No.: US 12,565,651 B2
(45) Date of Patent: *Mar. 3, 2026

(54) OLIGONUCLEOTIDES COMPRISING SEGMENTED GAP STRUCTURES

(71) Applicant: AusperBio Therapeutics Inc., San Mateo, CA (US)

(72) Inventors: Guofeng Cheng, Foster City, CA (US); Cheng Yong Yang, Foster City, CA (US)

(73) Assignee: AUSPERBIO THERAPEUTICS INC., Foster City, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/768,373

(22) Filed: Jul. 10, 2024

(65) Prior Publication Data

US 2024/0368602 A1     Nov. 7, 2024

Related U.S. Application Data

(63) Continuation of application No. PCT/CN2023/000030, filed on Jan. 10, 2023.

(60) Provisional application No. 63/298,092, filed on Jan. 10, 2022.

(51) Int. Cl.
*C12N 15/113* (2010.01)
*A61P 31/20* (2006.01)

(52) U.S. Cl.
CPC .......... *C12N 15/1131* (2013.01); *A61P 31/20* (2018.01); *C12N 2310/11* (2013.01); *C12N 2310/321* (2013.01); *C12N 2310/322* (2013.01); *C12N 2310/3231* (2013.01); *C12N 2310/3341* (2013.01); *C12N 2310/341* (2013.01)

(58) Field of Classification Search
CPC .......... C12N 15/1131; C12N 2310/321; C12N 2310/3231; C12N 2310/3341; C12N 2310/341; C12N 2310/11; C12N 2310/315; C12N 15/113; A61P 31/20
See application file for complete search history.

(56) References Cited

U.S. PATENT DOCUMENTS

| | | | |
|---|---|---|---|
| 4,522,811 A | 6/1985 | Eppstein et al. | |
| 6,268,490 B1 | 7/2001 | Imanishi et al. | |
| 6,525,191 B1 | 2/2003 | Ramasamy | |
| 6,670,461 B1 | 12/2003 | Wengel et al. | |
| 6,770,748 B2 | 8/2004 | Imanishi et al. | |
| 6,794,499 B2 | 9/2004 | Wengel et al. | |
| 7,034,133 B2 | 4/2006 | Wengel et al. | |
| 7,053,207 B2 | 5/2006 | Wengel | |
| 7,399,845 B2 | 7/2008 | Seth et al. | |
| 7,427,672 B2 | 9/2008 | Imanishi et al. | |
| 7,741,457 B2 | 6/2010 | Seth et al. | |
| 7,759,479 B1 | 7/2010 | Dobie et al. | |
| 7,919,472 B2 | 4/2011 | Monia et al. | |
| 8,501,805 B2 | 8/2013 | Seth et al. | |
| 8,530,640 B2 | 9/2013 | Seth et al. | |
| 8,541,388 B2 | 9/2013 | Monia et al. | |
| 8,546,556 B2 | 10/2013 | Seth et al. | |
| 8,642,752 B2 | 2/2014 | Swayze et al. | |
| 8,987,435 B2 | 3/2015 | Swayze et al. | |
| 9,145,558 B2 | 9/2015 | Prakash et al. | |
| 9,550,988 B2 | 1/2017 | Swayze | |
| 9,650,636 B2 | 5/2017 | Freier et al. | |
| 9,732,344 B2 | 8/2017 | Beigelman et al. | |
| 9,943,604 B2 | 4/2018 | Seth et al. | |
| 10,793,859 B2 | 10/2020 | Gryaznov et al. | |
| 11,466,274 B2 | 10/2022 | Beigelman et al. | |
| 12,077,757 B2 | 9/2024 | Gryaznov et al. | |
| 2004/0171570 A1 | 9/2004 | Allerson et al. | |
| 2005/0100885 A1* | 5/2005 | Crooke .............. | C12N 15/1137 435/5 |
| 2005/0130923 A1 | 6/2005 | Bhat et al. | |
| 2007/0287831 A1 | 12/2007 | Seth et al. | |
| 2007/0299027 A1 | 12/2007 | Hung et al. | |
| 2008/0039418 A1 | 2/2008 | Freier | |
| 2008/0039618 A1 | 2/2008 | Allerson et al. | |
| 2009/0023673 A1 | 1/2009 | Manoharan et al. | |
| 2009/0221685 A1* | 9/2009 | Esau ....................... | A61P 43/00 435/325 |
| 2012/0295959 A1 | 11/2012 | Collard et al. | |
| 2012/0295961 A1 | 11/2012 | Swayze et al. | |

(Continued)

FOREIGN PATENT DOCUMENTS

| | | | |
|---|---|---|---|
| AU | 2017201608 A1 | 3/2017 | |
| CA | 3094303 A1 * | 9/2019 | ......... A61K 31/7125 |

(Continued)

OTHER PUBLICATIONS

Inoue H, et al., FEBS Lett. May 11, 1987;215(2):327-30 (Year: 1987).*

Albaek et al., "Analogues of a locked nucleic acid with three-carbon 2',4'-linkages: synthesis by ring-closing metathesis and influence on nucleic acid duplex stability and structure" J Org Chem. Sep. 29, 2006; 71(20):7731-7740.

(Continued)

*Primary Examiner* — Ram R Shukla
*Assistant Examiner* — Shabana S Meyering
(74) *Attorney, Agent, or Firm* — COOLEY LLP

(57)     ABSTRACT

Disclosed herein are modified oligonucleotides complementary to a portion of a Hepatitis B virus (HBV) genome, wherein the modified oligonucleotides comprise a 5' wing segment, a first gap segment, a first separator segment comprising a 2' sugar modification, a second gap segment, and a 3' wing segment. Such modified oligonucleotides are useful to treat, prevent, or ameliorate HBV-related diseases, disorders or conditions.

7 Claims, 75 Drawing Sheets

Specification includes a Sequence Listing.

(56) References Cited

U.S. PATENT DOCUMENTS

| | | | | |
|---|---|---|---|---|
| 2013/0035366 A1* | 2/2013 | Swayze | A61P 31/14 |
| | | | 536/24.5 |
| 2016/0354476 A1 | 12/2016 | Seth et al. | |
| 2017/0145424 A1 | 5/2017 | Prakash et al. | |
| 2020/0385714 A1 | 12/2020 | Hagedorn et al. | |
| 2020/0407717 A1 | 12/2020 | Wang et al. | |
| 2021/0040483 A1 | 2/2021 | Gryaznov et al. | |
| 2021/0054383 A1 | 2/2021 | Hagedorn et al. | |
| 2021/0238591 A1 | 8/2021 | Seth et al. | |
| 2022/0339281 A1* | 10/2022 | Bayat | A61K 39/12 |
| 2022/0380761 A1 | 12/2022 | Oerum et al. | |
| 2023/0020092 A1 | 1/2023 | Qian et al. | |
| 2024/0299534 A1 | 9/2024 | Cheng et al. | |
| 2025/0215430 A1 | 7/2025 | Cheng et al. | |

FOREIGN PATENT DOCUMENTS

| | | | |
|---|---|---|
| CN | 105378085 A | 3/2016 |
| CN | 111344408 A | 6/2020 |
| CN | 111868245 A | 10/2020 |
| CN | 113573730 A | 10/2021 |
| CN | 114846140 A | 8/2022 |
| CN | 118667808 A | 9/2024 |
| EP | 2742056 B1 | 1/2017 |
| EP | 3556859 B1 | 4/2021 |
| WO | WO-9414226 A1 | 6/1994 |
| WO | WO-9839352 A1 | 9/1998 |
| WO | WO-9914226 A2 | 3/1999 |
| WO | WO-03004602 A2 | 1/2003 |
| WO | WO-2004106356 A1 | 12/2004 |
| WO | WO-2005021570 A1 | 3/2005 |
| WO | WO-2007134181 A2 | 11/2007 |
| WO | WO-2008101157 A1 | 8/2008 |
| WO | WO-2008150729 A2 | 12/2008 |
| WO | WO-2008154401 A2 | 12/2008 |
| WO | WO-2009006478 A2 | 1/2009 |
| WO | WO-2009148605 A2 | 12/2009 |
| WO | WO-2011047312 A1 | 4/2011 |
| WO | WO-2012109395 A1 | 8/2012 |
| WO | WO-2012145697 A1 | 10/2012 |
| WO | WO-2013022966 A1 | 2/2013 |
| WO | WO-2013022967 A1 | 2/2013 |
| WO | WO-2013022984 A1 | 2/2013 |
| WO | WO-2013022990 A1 | 2/2013 |
| WO | WO-2014179620 A1 | 11/2014 |
| WO | WO-2015021457 A2 | 2/2015 |
| WO | WO-2015173208 A2 | 11/2015 |
| WO | WO-2020178359 A1 | 9/2020 |
| WO | WO-2022100744 A1 | 5/2022 |
| WO | WO-2023083906 A2 | 5/2023 |
| WO | WO-2023131098 A2 | 7/2023 |
| WO | WO-2023131926 A2 | 7/2023 |
| WO | WO-2023144750 A1 | 8/2023 |
| WO | WO-2023187612 A1 | 10/2023 |
| WO | WO-2023194537 A1 | 10/2023 |
| WO | WO-2024149282 A1 | 7/2024 |
| WO | WO-2024221135 A1 | 10/2024 |
| WO | WO-2024222647 A1 | 10/2024 |
| WO | WO-2025242158 A1 | 11/2025 |

OTHER PUBLICATIONS

Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nucleosides and Nucleotides (1997) 16(7-9): 917-926.
Altmann et al., "Second Generation of Antisense Oligonucleotides: From Nuclease Resistance to Biological Efficacy in Animals" Chimia (1996) 50:168-176.
Altmann et al., "Second-generation antisense oligonucleotides: structure-activity relationships and the design of improved signal-transduction inhibitors" Biochem Soc Trans. Aug. 1996; 24(3):630-637.

Baker et al., "2'-O-(2-Methoxy)ethyl-modified anti-intercellular adhesion molecule 1 (ICAM-1) oligonucleotides selectively increase the ICAM-1 mRNA level and inhibit formation of the ICAM-1 translation initiation complex in human umbilical vein endothelial cells" J Biol Chem. May 2, 1997; 272(18):11994-12000.
Braasch et al., "Locked nucleic acid (LNA): fine-tuning the recognition of DNA and RNA" Chem Biol. Jan. 2001; 8(1):1-7.
Chattopadhyaya et al., "Fine tuning of electrostatics around the internucleotidic phosphate through incorporation of modified 2',4'-carbocyclic-LNAs and -ENAs leads to significant modulation of antisense properties" J Org Chem. Jan 2, 2009; 74(1):118-134.
Chulanov et al., "Kinetics of HBV DNA and HBsAg in acute hepatitis B patients with and without coinfection by other hepatitis viruses" J Med Virol. Mar. 2003; 69(3):313-323.
Cote et al., "Effects of age and viral determinants on chronicity as an outcome of experimental woodchuck hepatitis virus infection" Hepatology. Jan. 2000; 31(1):190-200.
Den Brouw et al., "Hepatitis B virus surface antigen impairs myeloid dendritic cell function: a possible immune escape mechanism of hepatitis B virus" Immunology. (2008) 126(2):280-289.
Elayadi et al., "Application of PNA and LNA oligomers to chemotherapy" Curr Opin Investig Drugs. Apr. 2001; 2(4):558-561.
Evans et al., "Programmed death 1 expression during antiviral treatment of chronic hepatitis B: Impact of hepatitis B e-antigen seroconversion" Hepatology. Sep. 2008; 48(3):759-769.
Freier et al., "The ups and downs of nucleic acid duplex stability: structure-stability studies on chemically-modified DNA:RNA duplexes" Nucleic Acids Res. Nov. 15, 1997; 25(22):4429-4443.
Fried et al., "HBeAg and hepatitis B virus DNA as outcome predictors during therapy with peginterferon alfa-2a for HBeAg-positive chronic hepatitis B" Hepatology. Feb. 2008; 47(2):428-434.
Frieden et al., "Expanding the design horizon of antisense oligonucleotides with alpha-L-LNA" Nucleic Acids Res. Nov. 1, 2003; 31(21):6365-6372.
Ganem et al., "Hepatitis B virus infection—natural history and clinical consequences" N Engl J Med. Mar. 11, 2004; 350(11):1118-1129.
Gautschi et al., "Activity of a novel bcl-2/bcl-xL-bispecific antisense oligonucleotide against tumors of diverse histologic origins" J Natl Cancer Inst. Mar. 21, 2001; 93(6):463-471.
GenBank Accession No. AB033550.1, Oct. 19, 1999, 3 pages.
GenBank Accession No. AJ309369.1, Aug. 15, 2001, 3 pages.
GenBank Accession No. D00330.1, Jul. 20, 2007, 2 pages.
GenBank Accession No. KP718112, Aug. 19, 2015, 3 pages.
GenBank Accession No. KX186584, Aug. 26, 2016, 3 pages.
GenBank Accession No. KX264500, May 31, 2016, 3 pages.
GenBank Accession No. KX264501, May 31, 2016, 3 pages.
GenBank Accession No. KX470733.1, Aug. 31, 2016, 6 pages.
GenBank Accession No. NM_000295.5, Aug. 12, 2024, 6 pages.
GenBank Accession No. NM_000371.4, Aug. 19, 2024, 4 pages.
GenBank Accession No. NM_004409.5, Aug. 4, 2024, 5 pages.
GenBank Accession No. NM_013697.5, Jul. 30, 2024, 4 pages.
GenBank Accession No. NM_174936.4, Jul. 23, 2024, 6 pages.
GenBank Accession No. NP_000286.3, Aug. 12, 2024, 4 pages.
GenBank Accession No. NP_000362.1, Aug. 19, 2024, 3 pages.
GenBank Accession No. NP_004400.4, Aug. 4, 2024, 4 pages.
GenBank Accession No. NP_777596.2, Jul. 23, 2024, 4 pages.
GenBank Accession No. U95551.1, Jun. 7, 1997, 3 pages.
International Search Report and Written Opinion for PCT Application No. PCT/CN2023/000030 dated Aug. 23, 2023, 16 pages.
International Search Report and Written Opinion for PCT Application No. PCT/CN2023/106924 dated Apr. 2, 2024, 15 pages.
International Search Report and Written Opinion mailed on Apr. 1, 2024, for International Application No. PCT/CN2024/071514, 19 pages.
International Search Report and Written Opinion mailed on Jun. 28, 2023, for International Application No. PCT/IB2023/050207, filed on Jan. 10, 2023, 14 pages.
Invitation to Pay Addiitonal Fees and, Where Applicable, Protest Fee mailed on Dec. 15, 2023, 2023, for International Application No. PCT/CN2023/106924, filed on Jul. 12, 2023, 2 pages.
Invitation to Pay Fee for International Application No. PCT/CN2023/000030 dated Jun. 1, 2023, 2 pages.

(56)                    References Cited

OTHER PUBLICATIONS

Javanbakht H., et al. "Liver-Targeted Anti-HBV Single-Stranded Oligonucleotides with Locked Nucleic Acid Potently Reduce HBV Gene Expression In Vivo" Mol Ther Nucleic Acids, vol. 11 , Feb. 23, 2018 (Feb. 23, 2018), 441-454.

Karlin et al., "Applications and statistics for multiple high-scoring segments in molecular sequences" PNAS USA (1993) 90:5873-5877.

Koshkin et al., "LNA (Locked Nucleic Acids): Synthesis of the adenine, cytosine, guanine, 5-methylcytosine, thymine and uracil bicyclonucleoside monomers, oligomerisation, and unprecedented nucleic acid recognition" Tatrahedron (1998) 54:3607-3630.

Kumar et al., "The first analogues of LNA (locked nucleic acids): phosphorothioate-LNA and 2'-thio-LNA" Bioorg Med Chem Lett. Aug. 18, 1998; 8(16):2219-2222.

Leumann, "DNA analogues: from supramolecular principles to biological properties" Bioorg Med Chem. Apr. 2002; 10(4):841-854.

Liang et al., "Hepatitis B e Antigen—the dangerous endgame of hepatitis B" N Engl J Med. Jul. 18, 2002; 347(3):208-210.

Maher and Dolnick, "Comparative hybrid arrest by tandem antisense oligodeoxyribonucleotides or oligodeoxyribonucleoside methylphosphonates in a cell-free system" Nucleic Acids Res. Apr. 25, 1988; 16(8):3341-3358.

Martin, "Ein neuer Zugang zu 2'-O-Alkylribonucleosiden und Eigenschaften deren Oligonucleotide" Helv. Chim. Acta (1995) 78:486-504.

Milich et al., "The secreted hepatitis B precore antigen can modulate the immune response to the nucleocapsid: a mechanism for persistence" J Immunol. Feb. 15, 1998; 160(4):2013-2021.

Moucari et al., "Early serum HBsAg drop: a strong predictor of sustained virological response to pegylated interferon alfa-2a in HBeAg-negative patients" Hepatology. Apr. 2009; 49(4):1151-1157.

Orum et al., "Locked nucleic acids: a promising molecular family for gene-function analysis and antisense drug development" Curr Opin Mol Ther. Jun. 2001; 3(3):239-243.

Reignat et al., "Escaping high viral load exhaustion: CD8 cells with altered tetramer binding in chronic hepatitis B virus infection" J Exp Med. May 6, 2002; 195(9):1089-1101.

Rukov et al., "Dissecting the target specificity of RNase H recruiting oligonucleotides using massively parallel reporter analysis of short RNA motifs" Nucleic Acids Res. Sep. 30, 2015; 43(17):8476-8487.

Seeger et al., "Hepatitis B virus biology" Microbiol Mol Biol Rev. Mar. 2000; 64(1):51-68.

Singh et al., "LNA (locked nucleic acids): synthesis and high-affinity nucleic acid recognition" Chem. Commun. (1998) 4:455-456.

Singh et al., "Synthesis of 2'-Amino-LNA: A Novel Conformationally Restricted High-Affinity Oligonucleotide Analogue with a Handle" J. Org. Chem. (1998) 63:10035-10039.

Srivastava et al., "Five- and six-membered conformationally locked 2',4'-carbocyclic ribo-thymidines: synthesis, structure, and biochemical studies" J Am Chem Soc. Jul. 4, 2007; 129(26):8362-8379.

Tarn et al., "Antisense Oligonucleotide-Based Therapy of Viral Infections" Pharmaceutics. Nov. 26, 2021; 13(12):2015. 18 pages.

Terazawa et al., "Hepatitis B virus mutants with precore-region defects in two babies with fulminant hepatitis and their mothers positive for antibody to hepatitis B e antigen" Pediatr Res. Jan. 1991; 29(1):5-9.

Wahlestedt et al., "Potent and nontoxic antisense oligonucleotides containing locked nucleic acids" PNAS USA (2000) 97:5633-5638.

Woolf et al., "Specificity of antisense oligonucleotides in vivo" PNAS USA (1992) 89:7305-7309.

Yuen M., et al., "Safety, tolerability and antiviral activity of the antisense oligonucleotide bepirovirsen in patients with chronic hepatitis B: a phase 2 randomized controlled trial," Nature Medicine, 2021, vol. 27(10), pp. 1725-1734.

Zheng et al., "Selective functional deficit in dendritic cell—T cell interaction is a crucial mechanism in chronic hepatitis B virus infection" J Viral Hepat. May 2004; 11(3):217-224.

Zhu, X., et al., "The difference of anti-virus effect between different modified antisense oligonucleotides in vitro" Chin J Hepatol, vol. 21, No. 6, Jun. 30, 2013, 475-476.

U.S. Appl. No. 18/727,839, filed Jul. 10, 2024, by Cheng et al.

EP Application No. 23736963.2, Partial Supplementary European Search Report mailed Nov. 17, 2025; Applicant AusperBio Therapeutics Inc.; 20 pages.

Gupta et al., "Clinical and Preclinical Single-Dose Pharmacokinetics of VIR-2218, an RNAi Therapeutic Targeting HBV Infection" Drugs in R&D Nov. 2021; 21(4):455-465.

PCT Application No. PCT/CN2025/096518, International Search Report and Written Opinion mailed Aug. 31, 2025; Applicant AusperBio Therapeutics, Inc.; 12 pages.

Sandra et al., "Plasma and Liver Pharmacokinetics of the N-Acetylgalactosamine Short Interfering RNA JNJ-73763989 in Recombinant Adeno-Associated-Hepatitis B Virus-Infected Mice" The Journal of Pharmacology and Experimental Therapeutics Oct. 2022; 383:70-79.

Tan et al., "Combination drug interactions of hepatitis B virus (HBV) small interfering RNA (siRNA) and antisense oligonucleotides (ASO) in vitro and in vivo" The Journal of Hepatology Dec. 2021, 75(2):S720, 1 page.

U.S. Appl. No. 19/146,769, filed Jul. 9, 2025; Inventor Cheng, Guofeng et al.

U.S. Appl. No. 19/366,428, filed Oct. 22, 2025; Inventor Cheng, Guofeng et al.

PCT Application No. PCT/CN2025/096518, filed May 22, 2025; Applicant AusperBio Therapeutics, Inc.; 110 pages.

Hill et al., "The MOE Modification of RNA: Origins and Widescale Impact on the Oligonucleotide Therapeutics Field" Helvetica Chimica Acta Mar. 2023; 106(3):e202200169, 15 pages.

Stein et al., "Efficient gene silencing by delivery of locked nucleic acid antisense oligonucleotides, unassisted by transfection reagents" Nucleic Acids Res. Jan. 2010; 38(1):e3, 8 pages.

* cited by examiner

Table 1.1

Legend

| Symbol | Description | Representations | Examples |
|---|---|---|---|
| n | lower case | 2'-deoxy nucleoside | c stands for 2'-deoxy 5-methylcytidine, a stands for 2'-deoxy adenosine, g stands for 2'-deoxy guanosine, and t stands for 2'-deoxy thymidine. |
| N | UPPER CASE | 2'-O-methoxyethyl nucleoside | C stands for 2'-O-methoxyethyl 5-methylcytidine, A stands for 2'-O-methoxyethyl adenosine, G stands for 2'-O-methoxyethyl guanosine, T stands for 2'-O-methoxyethyl thymidine, and U stands for 2'-O-methoxyethyl uridine |
| C | UPPER CASE, Underlined | 2'-O-methoxyethyl cytidine | C stands for 2'-O-methoxyethyl cytidine (namely regular unmethylated cytidine with 2'-O-methoxyethyl modification) |
| c | lower case c, underlined | 2'-deoxy cytidine | c stands for 2'-deoxy cytidine (namely regular unmethylated 2'-deoxy cytidine). |
| N | UPPER CASE ITALICIZED | 2'-O-methyl nucleoside | C stands for 2'-O-methyl 5-methylcytidine, A stands for 2'-O-methyl adenosine, G stands for 2'-O-methyl guanosine, T stands for 2'-O-methyl thymidine, and U stands for 2'-O-methyl uridine |
| n | lower case bold italicized | 2'-OH nucleoside | c stands for 2'-OH 5-methylcytidine (or 5-methyl cytidine), a stands for 2'-OH adenosine (or adenosine), g stands for 2'-OH guanosine (or guanosine), and u stands for 2'-OH uridine (or uridine). |
| N | UPPER CASE bold | Glycol nucleic acid (GNA) | A stands for a GNA with adenine base, C stands for a GNA with 5-methylcytosine base. |
| +N | UPPER CASE with a + sign in front | Locked nucleic acid (LNA) | +A stands for a LNA with adenine base, +C stands for a LNA with 5-methylcytosine base, +G stands for a LNA with guanine base, +T stands for a LNA with thymine base, +U stands for a LNA with uracil base |
| +C | UPPER CASE underlined with a + sign in front | Locked nucleic acid (LNA) with cytosine base | +C stands for a LNA with regular cytosine base (unmethylated) |
| N' | UPPER CASE followed by a ' sign | 2'-Fluoro 2'-deoxy nucleoside | A stands for 2'-fluoro 2'-deoxy adenosine, C stands for 2'-fluoro 2'-deoxy 5-methylcytidine, G stands for 2'-fluoro 2'-deoxy guanosine, U stands for 2'-fluoro 2'-deoxy uridine |
| C' | UPPER CASE underlined followed by a ' sign | 2'-Fluoro 2'-deoxy cytidine | C stands for 2'-fluoro 2'-deoxy cytidine (unmethylated) |
| N'' | UPPER CASE followed by a '' sign | 2'-F-Arabinonucleic Acid (2'-F-ANA) | A stands for a 2'-F-ANA with adenine base, T stands for a 2'-F-ANA with thymine base, G stands for a 2'-F-ANA with guanine base |
| C'' | UPPER CASE underlined followed by a '' sign | 2'-F-ANA with cytosine base | C stands for a 2'-F-ANA with cytosine base |

FIG. 1

Table 1.2

FIG. 2A

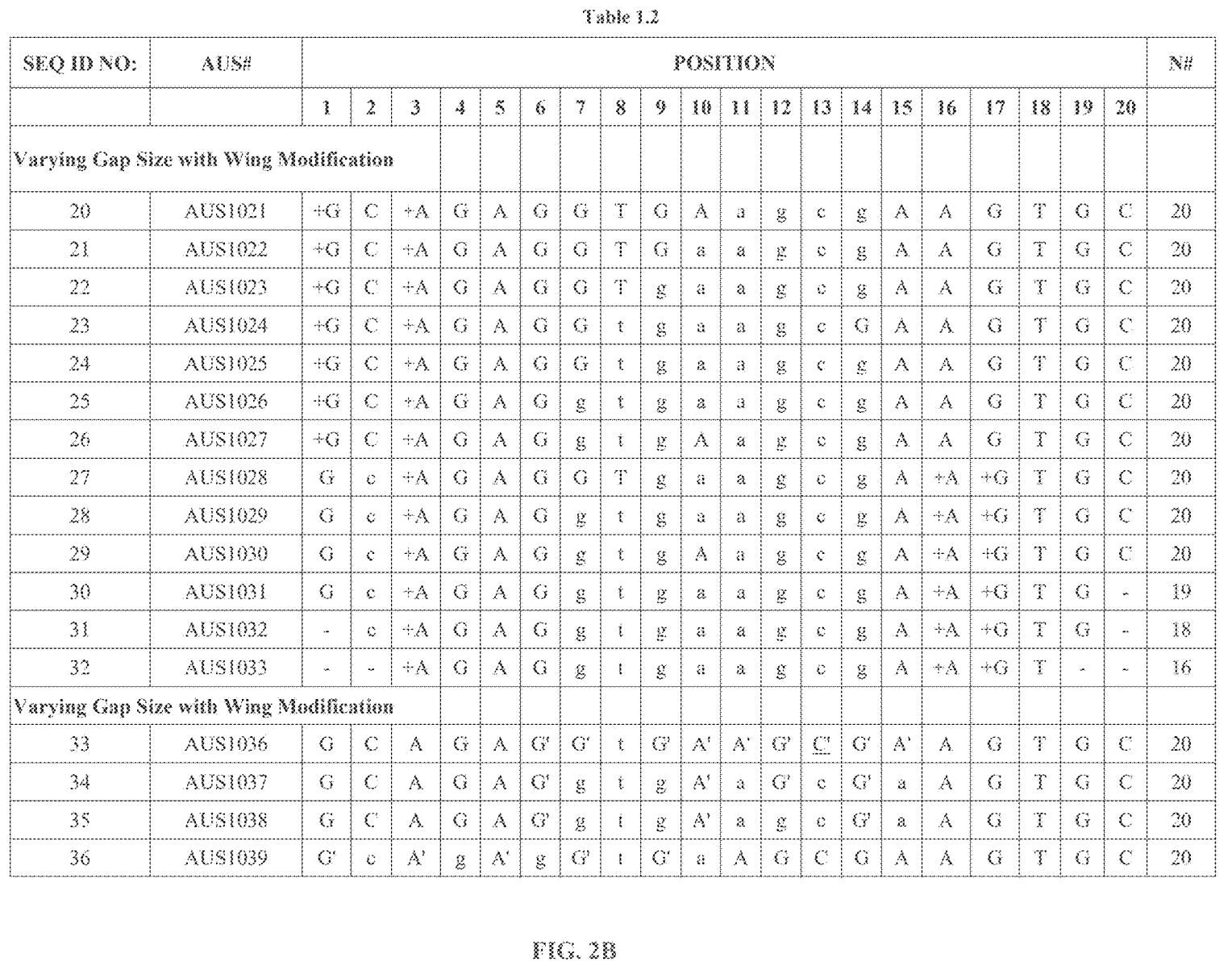

Table 1.2

| SEQ ID NO: | AUS# | POSITION | | | | | | | | | | | | | | | | | | | | N# |
|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | |
| Varying Gap Size with Wing Modification | | | | | | | | | | | | | | | | | | | | | | |
| 20 | AUS1021 | +G | C | +A | G | A | G | G | T | T G | A | a | gg | c | gg | A | A | G | T | G | C | 20 |
| 21 | AUS1022 | +G | C | +A | G | A | G | G | T | G | a | a | g | c | gg | A | A | G | T | G | C | 20 |
| 22 | AUS1023 | +G | C | +A | G | A | G | G | T | gg | a | a | gg | c | gg | A | A | G | T | G | C | 20 |
| 23 | AUS1024 | +G | C | +A | G | A | G | G | t | gg | a | a | gg | c | G | A | A | G | T | G | C | 20 |
| 24 | AUS1025 | +G | C | +A | G | A | G | G | t | gg | a | a | gg | c | gg | A | A | G | T | G | C | 20 |
| 25 | AUS1026 | +G | C | +A | G | A | G | gg | t | gg | A | a | gg | c | gg | A | A | G | T | G | C | 20 |
| 26 | AUS1027 | +G | C | +A | G | A | G | gg | T | gg | a | a | g | c | gg | A | +A | G | T | G | C | 20 |
| 27 | AUS1028 | G | C | +A | G | A | G | G | t | gg | A | a | gg | c | gg | A | +A | +G | T | G | C | 20 |
| 28 | AUS1029 | G | c | +A | G | A | G | gg | t | gg | a | a | gg | c | gg | A | +A | +G | T | G | C | 20 |
| 29 | AUS1030 | G | C | +A | G | A | G | gg | t | gg | A | a | gg | c | gg | A | +A | +G | T | G | C | 20 |
| 30 | AUS1031 | G | c | +A | G | A | G | gg | t | gg | a | a | g | c | gg | A | +A | +G | T | G | C | 19 |
| 31 | AUS1032 | - | o | +A | G | A | G | gg | t | gg | a | a | g | c | gg | A | +A | +G | T | G | - | 18 |
| 32 | AUS1033 | - | - | +A | G | A | G | g | t | g | | A | | c | gg | A | +A | +G | T | - | - | 16 |
| Varying Gap Size with Wing Modification | | | | | | | | | | | | | | | | | | | | | | |
| 33 | AUS1036 | G | C | A | G | A | G | G | t | G | A' | A' | G' | C' | G' | A' | A | G | T | G | C | 20 |
| 34 | AUS1037 | G | C | A | G | A | G | gg | t | gg | A' | A' | G' | c | G' | a | A | G | T | G | C | 20 |
| 35 | AUS1038 | G | C | A | G | A | G | gg | t | gg | A' | a | g | c | G' | a | A | G | T | G | C | 20 |
| 36 | AUS1039 | G | o | A' | g | A' | gg | gg | t | G | a | A | G | c | G | A | A | G | T | G | C | 20 |

FIG. 2B

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | N# |
|---|---|---|---|---|---|---|---|---|---|---|---|---|---|---|---|---|---|---|---|---|---|---|---|---|---|---|
| Gap shifting | | | | | | | | | | | | | | | | | | | | | | | | | | |
| 37 | AUS1042 | G | A | C | G | T | g | c | a | g | a | g | g | t | g | a | A | g | C | G | A | A | | | | 20 |
| 38 | AUS1043 | G | A | C | G | T | G | c | a | g | a | g | g | t | g | a | a | g | C | G | A | A | | | | 20 |
| 39 | AUS1044 | G | | | G | T | G | C | a | g | a | g | g | t | g | a | a | g | C | G | A | A | G | | | 20 |
| 40 | AUS1045 | G | | | G | T | G | C | A | g | a | g | g | t | g | a | a | g | c | G | A | A | G | T | | 20 |
| 41 | AUS1046 | | | | | T | G | C | A | G | a | g | g | t | g | a | a | g | c | g | A | A | G | T | G | 20 |
| Separator Segment Position Changes | | | | | | | | | | | | | | | | | | | | | | | | | | |
| 42 | AUS1049 | G | C | A | G | A | g | g | t | g | A | a | g | c | g | a | A | G | T | G | C | | | | | 20 |
| 43 | AUS1050 | G | C | A | G | A | g | g | t | g | A' | a | g | c | g | a | A | G | T | G | C | | | | | 20 |
| 44 | AUS1051 | G | C | A | G | A | g | g | t | g | +A | a | g | c | g | a | A | G | T | G | C | | | | | 20 |
| 45 | AUS1052 | G | C | A | G | A | g | g | t | g | a | a | g | c | g | a | A | G | T | G | C | | | | | 20 |
| 46 | AUS1053 | G | C | A | G | A | g | g | t | g | a | a | g | c | g | a | A | G | T | G | C | | | | | 20 |
| 47 | AUS1054 | G | C | A | G | A | g | g | t | g | a | a | g | C | G | a | A | G | T | G | C | | | | | 20 |
| 48 | AUS1055 | G | C | A | G | A | g | g | t | g | A | a | g | c | g | a | A | G | T | G | C | | | | | 20 |
| 49 | AUS1056 | G | C | A | G | A | g | g | t | g | a | A | g | c | g | A | A | G | T | G | C | A | | | | 20 |
| 50 | AUS1057 | G | C | A | G | A | g | g | t | g | a | a | g | c | g | a | A | G | T | G | C | | | | | 20 |
| 51 | AUS1058 | G | C | A | G | A | g | g | t | g | a | a | g | c | g | a | A | G | T | G | C | | | | | 20 |
| 52 | AUS1059 | G | C | A | G | A | g | g | T | g | a | a | g | c | g | a | A | G | T | G | C | | | | | 20 |
| 53 | AUS1060 | G | C | A | G | A | G | G | t | G | a | a | g | c | g | a | A | G | T | G | C | | | | | 20 |
| 54 | AUS1061 | G | C | A | G | A | g | g | t | g | a | a | g | c | g | a | A | G | T | G | C | | | | | 20 |

FIG. 2C

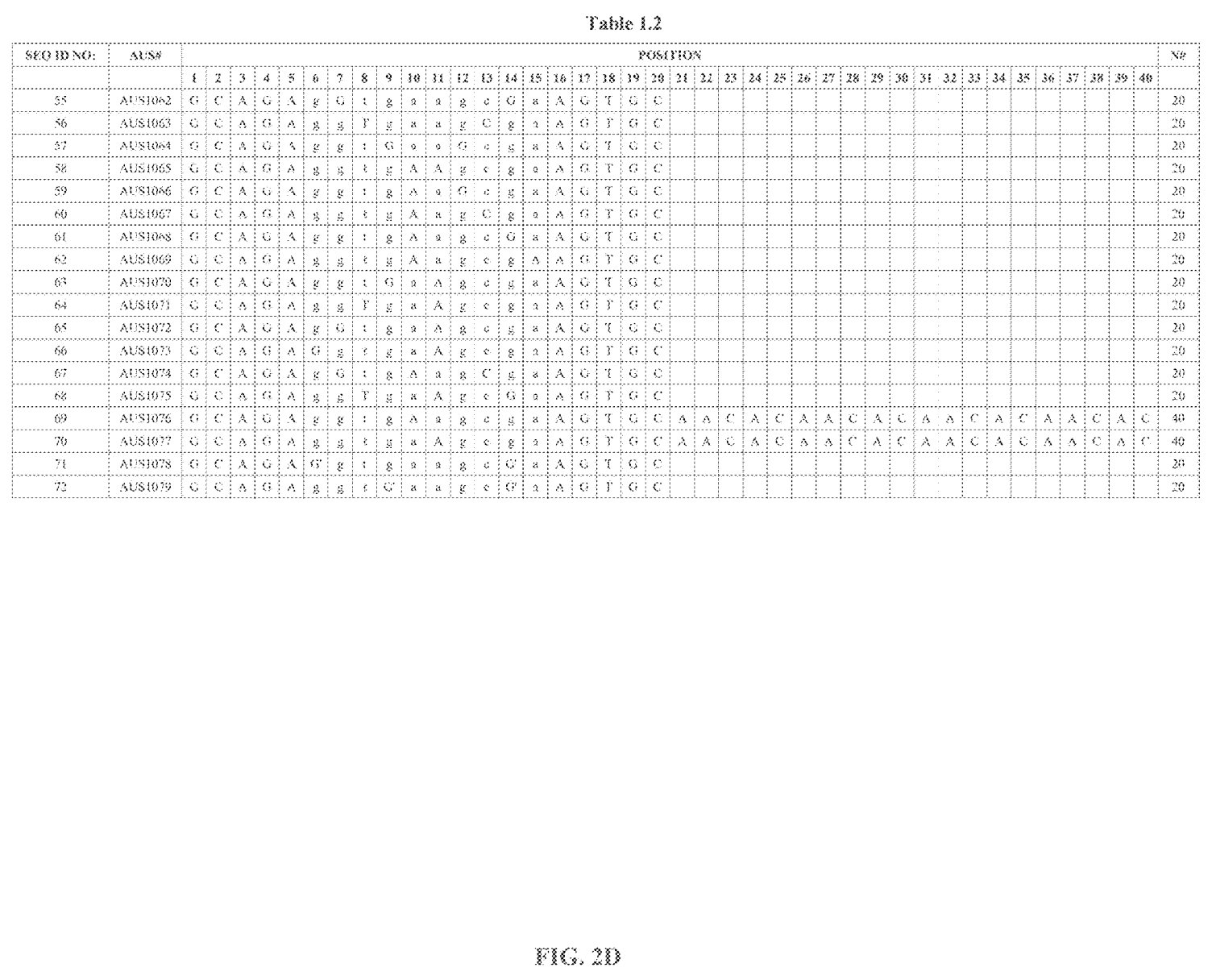

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | N# |
|---|---|---|---|---|---|---|---|---|---|---|---|---|---|---|---|---|---|---|---|---|---|---|---|---|---|---|---|---|---|---|---|---|---|---|---|---|---|---|---|---|---|---|
|  |  |  |  |  |  |  |  |  |  |  |  |  |  |  |  |  |  |  |  |  |  |  |  |  |  |  |  |  |  |  |  |  |  |  |  |  |  |  |  |  |  | POSITION |
| 55 | AUS1062 | G | C | A | G | A |  |  |  |  |  |  |  |  | G |  | A | G | T | G | C |  |  |  |  |  |  |  |  |  |  |  |  |  |  |  |  |  |  |  |  | 20 |
| 56 | AUS1063 | G | C | A | G | A |  |  |  |  |  |  |  |  | G |  | A | G | T | G | C |  |  |  |  |  |  |  |  |  |  |  |  |  |  |  |  |  |  |  |  | 20 |
| 57 | AUS1064 | G | C | A | G | A |  |  |  |  |  |  |  |  | G |  | A | G | T | G | C |  |  |  |  |  |  |  |  |  |  |  |  |  |  |  |  |  |  |  |  | 20 |
| 58 | AUS1065 | G | C | A | G | A |  |  |  |  |  |  |  |  | G |  | A | G | T | G | C |  |  |  |  |  |  |  |  |  |  |  |  |  |  |  |  |  |  |  |  | 20 |
| 59 | AUS1066 | G | C | A | G | A |  |  |  |  |  |  |  |  | G |  | A | G | T | G | C |  |  |  |  |  |  |  |  |  |  |  |  |  |  |  |  |  |  |  |  | 20 |
| 60 | AUS1067 | G | C | A | G | A |  |  |  |  |  |  |  |  | G |  | A | G | T | G | C |  |  |  |  |  |  |  |  |  |  |  |  |  |  |  |  |  |  |  |  | 20 |
| 61 | AUS1068 | G | C | A | G | A |  |  |  |  |  |  |  |  | G |  | A | G | T | G | C |  |  |  |  |  |  |  |  |  |  |  |  |  |  |  |  |  |  |  |  | 20 |
| 62 | AUS1069 | G | C | A | G | A |  |  |  |  |  |  |  |  | G |  | A | G | T | G | C |  |  |  |  |  |  |  |  |  |  |  |  |  |  |  |  |  |  |  |  | 20 |
| 63 | AUS1070 | G | C | A | G | A |  |  |  |  |  |  |  |  | G |  | A | G | T | G | C |  |  |  |  |  |  |  |  |  |  |  |  |  |  |  |  |  |  |  |  | 20 |
| 64 | AUS1071 | G | C | A | G | A |  |  |  |  |  |  |  |  | G |  | A | G | T | G | C |  |  |  |  |  |  |  |  |  |  |  |  |  |  |  |  |  |  |  |  | 20 |
| 65 | AUS1072 | G | C | A | G | A |  |  |  |  |  |  |  |  | G |  | A | G | T | G | C |  |  |  |  |  |  |  |  |  |  |  |  |  |  |  |  |  |  |  |  | 20 |
| 66 | AUS1073 | G | C | A | G | A |  |  |  |  |  |  |  |  | G |  | A | G | T | G | C |  |  |  |  |  |  |  |  |  |  |  |  |  |  |  |  |  |  |  |  | 20 |
| 67 | AUS1074 | G | C | A | G | A |  |  |  |  |  |  |  |  | G |  | A | G | T | G | C |  |  |  |  |  |  |  |  |  |  |  |  |  |  |  |  |  |  |  |  | 20 |
| 68 | AUS1075 | G | C | A | G | A |  |  |  |  |  |  |  |  | G |  | A | G | T | G | C |  |  |  |  |  |  |  |  |  |  |  |  |  |  |  |  |  |  |  |  | 20 |
| 69 | AUS1076 | G | C | A | G | A |  |  |  |  |  |  |  |  | G |  | A | G | T | G | C | A | A | C | A | C | A | A | C | A | A | A | A | C | A | C | A | A | C | A | C | 40 |
| 70 | AUS1077 | G | C | A | G | A |  |  |  |  |  |  |  |  | G |  | A | G | T | G | C | A | A | G | A | C | A | A | C | A | C | A | A | C | A | C | A | A | C | A | C | 40 |
| 71 | AUS1078 | G | C | A | G | A |  |  |  |  |  |  |  |  | G |  | A | G | T | G | C |  |  |  |  |  |  |  |  |  |  |  |  |  |  |  |  |  |  |  |  | 28 |
| 72 | AUS1079 | G | C | A | G | A |  |  |  |  |  |  |  |  | G |  | A | G | T | G | C |  |  |  |  |  |  |  |  |  |  |  |  |  |  |  |  |  |  |  |  | 20 |

FIG. 2D

Table 1.2

Modified Oligonucleotides targeting other HBV targets

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 73 | AUS1081 | G | T | G | A | A | G | c | g | a | b | g | t | g | c | b | C | A | C | G | G |  |
| 74 | AUS1082 | G | T | G | A | A | g | c | g | a | b | g | t | g | c | b | C | A | C | G | G | 20 |
| 75 | AUS1083 | G | T | G | A | A | g | c | G | a | b | g | t | g | c | b | C | A | C | G | G | 20 |
| 76 | AUS1084 | G | T | G | A | A | g | c | g | A | b | g | t | g | c | b | C | A | C | G | G | 20 |
| 77 | AUS1085 | G | T | G | A | A | g | c | g | a | A | g | t | g | c | b | C | A | C | G | G | 20 |
| 78 | AUS1086 | G | T | G | A | A | g | c | g | a | b | G | t | g | c | b | C | A | C | G | G | 20 |
| 79 | AUS1087 | G | T | G | A | A | g | c | g | a | b | g | t | G | c | b | C | A | C | G | G | 20 |
| 80 | AUS1088 | G | T | G | A | A | g | c | g | a | b | g | t | g | c | A | C | A | C | G | G | 20 |
| 81 | AUS1089 | G | T | G | A | A | g | c | g | a | b | g | t | g | c | b | C | A | C | G | G | 20 |
| 82 | AUS1090 | G | T | G | A | A | g | c | g | a | A | g | t | g | c | b | C | A | C | G | G | 20 |
| 83 | AUS1091 | G | T | G | A | A | g | c | g | a | A | g | t | g | c | b | C | A | C | G | G | 20 |
| 84 | AUS1092 | G | T | G | A | A | g | c | g | a | A | G | t | g | c | b | C | A | C | G | G | 20 |
| 85 | AUS1093 | G | T | G | A | A | g | c | g | a | A | g | t | g | c | A | C | A | C | G | G | 20 |
| 86 | AUS1094 | G | T | G | A | A | g | c | g | a | A | g | t | g | c | b | C | A | C | G | G | 20 |
| 87 | AUS1095 | G | T | G | A | A | g | c | g | a | A | g | t | g | c | b | C | A | C | G | G | 20 |
| 88 | AUS1096 | G | T | G | A | A | G | c | g | a | b | C | t | g | c | b | C | A | C | G | G | 20 |
| 89 | AUS1097 | G | T | G | A | A | g | c | g | a | b | G | t | G | c | b | C | A | C | G | G | 20 |
| 90 | AUS1098 | G | T | G | A | A | g | c | g | a | b | g | t | g | c | A | C | A | C | G | G | 20 |
| 91 | AUS1099 | G | T | G | A | A | g | c | g | a | A | g | t | g | c | b | C | A | C | G | G | 20 |
| 92 | AUS1100 | G | T | G | A | A | g | c | g | a | b | G | t | g | c | b | C | A | C | G | G | 20 |
| 93 | AUS1101 | G | T | G | A | A | g | c | g | a | A | g | t | G | c | b | C | A | C | G | G | 20 |
| 94 | AUS1102 | G | T | G | A | A | g | c | g | a | b | g | t | g | c | A | C | A | C | G | G | 20 |
| 95 | AUS1103 | G | T | G | A | A | g | c | G | a | b | G | t | g | c | b | C | A | C | G | G | 20 |

POSITION

FIG. 2E

Table 1.2

| SEQ ID NO: | AUS# | \_ POSITION \_ |||||||||||||||||||| N# |
|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | |
| | Separator Segment Position Change | | | | | | | | | | | | | | | | | | | | | | |
| 96 | AUS1105 | G | C | A | G | A | g | g | t | g | a | a | g | c | g | a | A | G | T | G | C | 20 |
| 97 | AUS1106 | G | C | A | G | A | g | g | t | g | a | a | g | c | g | a | A | G | T | G | C | 20 |
| 98 | AUS1107 | G | C | A | G | A | g | g | g | g | a | a | g | c | g | a | A | G | T | G | C | 20 |
| 99 | AUS1108 | G | C | A | G | A | g | g | t | g | a | a | g | c | g | a | A | G | T | G | C | 20 |
| 100 | AUS1109 | G | C | A | G | A | g | g | t | g | a | a | g | c | g | a | A | G | T | G | C | 20 |
| 101 | AUS1110 | G | C | A | G | A | g | g | t | g | a | a | g | c | g | a | A | G | T | G | C | 20 |
| 102 | AUS1111 | G | C | A | G | A | g | g | t | g | a | a | g | c | g | a | A | G | T | G | C | 20 |
| 103 | AUS1112 | G | C | A | G | A | g | g | t | g | a | a | g | c | g | a | A | G | T | G | C | 20 |
| 104 | AUS1113 | G | C | A | G | A | g | g | a | g | a | a | g | c | g | a | A | G | T | G | C | 20 |
| 105 | AUS1114 | G | C | A | G | A | g | g | t | g | a | a | g | c | g | a | A | G | T | G | C | 20 |
| 106 | AUS1116 | G | C | A | G | A | g | g | t | g | t | t | g | c | g | a | A | G | T | G | C | 20 |
| 107 | AUS1117 | G | C | A | G | A | g | g | t | c | a | a | g | c | g | a | A | G | T | G | C | 20 |
| 108 | AUS1118 | G | C | A | G | A | g | g | t | g | a | a | g | c | g | a | A | G | T | G | C | 20 |
| 109 | AUS1119 | G | C | A | G | A | g | g | t | g | a | a | g | c | g | a | A | G | T | G | C | 20 |
| 110 | AUS1120 | G | C | A | G | A | g | g | t | g | a | a | c | g | c | a | A | G | T | G | C | 20 |
| 111 | AUS1121 | G | C | A | G | A | g | g | t | g | a | a | g | c | g | t | A | G | T | G | C | 20 |
| 112 | AUS1122 | G | C | A | G | A | g | g | t | g | a | a | g | c | g | a | A | G | T | G | C | 20 |
| 113 | AUS1123 | G | C | A | G | A | g | g | t | g | a | a | g | c | g | a | A | G | T | G | C | 20 |
| 114 | AUS1124 | G | C | A | G | A | g | g | t | g | a | a | g | c | c | t | T | G | T | G | C | 20 |
| 115 | AUS1125 | G | C | A | G | A | g | g | t | g | a | a | g | c | g | a | A | G | T | G | C | 20 |
| 116 | AUS1126 | G | C | A | G | A | g | g | t | g | a | a | g | c | g | a | A | G | T | G | C | 20 |
| 117 | AUS1127 | G | C | A | G | A | g | G | t | g | a | a | g | c | g | a | A | G | T | G | C | 20 |

FIG. 2F

Table 1.2

| SEQ ID NO: | ALIS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 118 | AUSI128 | G | C | A | G | A | g | g | U | g | a | a | g | c | g | a | A | G | T | G | C | 20 |
| 119 | AUSI129 | G | C | A | G | A | g | g | t | G | a | a | g | c | g | a | A | G | T | G | C | 20 |
| 120 | AUSI130 | G | C | A | G | A | g | g | t | g | A | a | g | c | g | a | A | G | T | G | C | 20 |
| 121 | AUSI131 | G | C | A | G | A | g | g | t | g | a | A | g | c | g | a | A | G | T | G | C | 20 |
| 122 | AUSI132 | G | C | A | G | A | g | g | t | g | a | a | G | c | g | a | A | G | T | G | C | 20 |
| 123 | AUSI133 | G | C | A | G | A | g | g | t | g | a | a | g | C | g | a | A | G | T | G | C | 20 |
| 124 | AUSI134 | G | C | A | G | A | G | g | t | g | a | a | g | c | G | a | A | G | T | G | C | 20 |
| 125 | AUSI135 | G | C | A | G | A | g | g | t | g | a | A | g | c | g | A | A | G | T | G | C | 20 |
| 126 | AUSI136 | G | C | A | G | A | g | g | t | g | a | a | g | c | g | a | A | G | T | G | C | 20 |
| 127 | AUSI137 | G | C | A | G | A | g | g | t | t | A | a | g | a | g | A | A | G | T | G | C | 20 |
| 128 | AUSI139 | G | G | T | A | C | g | g | c | c | g | g | t | g | g | g | G | A | G | A | C | 20 |
| 129 | AUSI140 | C | G | G | A | C | c | g | a | a | g | g | g | a | g | g | T | C | A | C | A | 20 |
| 130 | AUSI141 | G | G | C | A | G | c | g | a | c | a | a | g | a | g | g | G | C | T | G | C | 20 |
| 131 | AUSI142 | G | G | C | A | A | g | g | t | a | a | a | g | c | g | a | A | G | G | G | C | 20 |
| 132 | AUSI143 | G | C | A | G | A | g | g | T" | g | A" | A" | g | c | g | a | G | G | G | G | A | 20 |
| 133 | AUSI144 | G | C | A | G | A | g | g | t | g | a | a | g | c | g | a | A | G | G | G | C | 20 |
| 134 | AUSI145 | G | C | A | G | A | g | g | t | g | a | a | g | c | G" | a | A | G | G | G | C | 20 |
| 135 | AUSI146 | G | C | A | G | A | g | g | t | g | A" | a | g | c | G" | a | A | G | G | G | C | 20 |
| 136 | AUSI147 | G | C | A | G | A | g | g | t | g | A | a | g | c | g | a | A | G | T | G | C | 20 |
| 137 | AUSI148 | G | C | A | G | A | g | g | t | g | a | a | g | c | g | a | A | G | T | G | C | 20 |
| 138 | AUSI149 | G | C | A | G | A | g | g | t | g | a | A | g | c | g | a | A | G | T | G | C | 20 |

POSITION

FIG. 2G

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | 21 | 22 | N# |
|---|---|---|---|---|---|---|---|---|---|---|---|---|---|---|---|---|---|---|---|---|---|---|---|---|
| 139 | AUS1151 | g | c | A | G | A | G | g | t | g | g | a | g | c | g | g | A | C | T | G | C | | | |
| 140 | AUS1152 | g | c | A | G | A | G | g | t | g | g | A | g | c | g | g | A | G | A | G | C | | | 20 |
| 141 | AUS1153 | g | c | A | G | A | G | g | t | g | g | A | g | c | g | g | A | G | T | C | G | | | 20 |
| 142 | AUS1154 | g | c | A | G | A | G | g | t | g | g | A | g | c | g | g | A | G | T | G | G | | | 20 |
| 143 | AUS1156 | g | c | A | G | A | g | g | t | g | g | a | g | C | g | g | A | G | T | G | C | | | 20 |
| 144 | AUS1157 | g | c | A | G | A | g | g | t | g | g | a | g | c | g | g | A | G | T | G | C | | | 20 |
| 145 | AUS1158 | g | c | A | G | A | g | g | t | g | g | A | g | C | g | g | A | G | T | G | C | | | 20 |
| 146 | AUS1159 | g | c | A | G | A | G | g | t | g | g | A | g | C | g | g | A | G | T | G | C | | | 20 |
| 147 | AUS1160 | g | c | A | G | A | G | g | t | g | g | A | g | c | g | g | A | G | T | G | C | | | 20 |
| 148 | AUS1161 | g | c | A | G | A | G | g | t | g | g | A | g | C | g | g | A | G | T | G | C | | | 20 |
| 149 | AUS1162 | g | c | A | G | A | G | g | t | g | g | A | g | C | g | g | +A | G | +T | G | +C | | | 20 |
| 150 | AUS1163 | g | c | A | G | A | g | g | t | g | g | a | g | C | g | g | +A | G | +T | G | +C | | | 20 |
| 151 | AUS1164 | g | c | A | G | A | G | g | t | g | A | A | g | C | g | g | +A | G | +T | G | +C | | | 20 |
| 152 | AUS1165 | g | c | +A | G | A | G | g | t | g | g | A | g | C | g | g | +A | G | +T | G | +C | | | 20 |
| 153 | AUS1166 | t | g | a | 5 | t | g | t | g | g | g | C | g | C | t | C | g | g | g | a | t | g | a | 22 |
| 154 | AUS1168 | g | c | A | G | A | g | g | t | g | g | A | g | c | g | g | A | G | T | G | C | | | 20 |
| 155 | AUS1169 | g | c | A | G | A | g | g | t | g | g | a | g | c | g | g | A | G | T | G | C | | | 20 |
| 156 | AUS1170 | g | c | A | G | A | g | g | t | g | g | a | g | c | g | g | A | G | T | G | C | | | 20 |
| 157 | AUS1171 | g | c | A | G | A | g | g | t | g | A | a | g | c | g | A | A | G | T | G | C | | | 20 |
| 158 | AUS1173 | g | c | A | G | A | g | g | t | g | A | a | g | c | g | g | A | G | T | G | C | | | 20 |
| 159 | AUS1174 | g | c | A | G | A | g | g | t | g | A | a | g | c | g | g | A | G | T | G | C | | | 20 |
| 160 | AUS1175 | g | c | A | G | a | g | g | t | g | A | a | g | c | g | g | A | G | T | G | C | | | 20 |
| 161 | AUS1176 | g | c | A | G | a | g | g | t | g | g | a | g | c | g | g | A | G | T | G | C | | | 20 |
| 162 | AUS1177 | g | c | A | G | A | g | g | t | g | g | a | g | c | g | g | A | G | U | G | C | | | 20 |

POSITION

FIG. 2H

Table 1.2

| SEQ ID NO: | AUS# | POSITION | | | | | | | | | | | | | | | | | | | | | N# |
| | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | |
| 163 | AUS1178 | G | C | A | G | A | g | g | t | g | A | b | g | c | g | b | A | G | U | G | C | | | |
| 164 | AUS1179 | G | C | A | G | A | G | g | t | g | b | b | g | c | g | b | A | G | U | G | C | | | 20 |
| 165 | AUS1180 | G | C | A | G | A | g | G | t | g | b | b | g | c | g | b | A | G | U | G | C | | | 20 |
| 166 | AUS1181 | G | C | A | G | A | g | g | U | g | b | b | g | c | g | b | A | G | U | G | C | | | 20 |
| 167 | AUS1182 | G | C | A | G | A | g | g | t | G | b | b | g | c | g | b | A | G | U | G | C | | | 20 |
| 168 | AUS1183 | G | C | A | G | A | g | g | t | g | b | A | g | c | g | b | A | G | U | G | C | | | 20 |
| 169 | AUS1184 | G | C | A | G | A | g | g | t | g | b | b | C | c | g | b | A | G | U | G | C | | | 20 |
| 170 | AUS1185 | G | C | A | G | A | g | g | t | g | b | b | g | c | g | b | A | G | U | G | C | | | 20 |
| 171 | AUS1186 | G | C | A | G | A | g | g | t | g | b | b | g | c | C | b | A | G | U | G | C | | | 20 |
| 172 | AUS1187 | G | C | A | G | A | g | g | t | g | A | b | g | c | g | A | A | G | U | G | C | | | 20 |
| 173 | AUS1188 | G | C | A | G | A | g | g | t | g | b | A | g | c | g | A | A | G | U | G | C | | | 20 |
| 174 | AUS1189 | G | C | A | G | A | G | g | t | g | A | b | g | c | g | b | A | G | U | G | C | | | 20 |
| 175 | AUS1190 | G | C | A | G | A | g | g | t | g | b | b | g | c | g | b | A | G | U | G | C | | | 20 |
| 176 | AUS1191 | G | C | A | G | A | g | g | t | g | A | A | g | c | g | A | A | G | U | G | C | | | 20 |
| 177 | AUS1192 | G | C | A | G | A | g | g | t | g | b | b | g | c | g | b | A | G | U | G | C | | | 20 |
| 178 | AUS1193 | G | C | A | G | A | g | g | t | g | b | b | g | t | g | b | A | G | U | G | C | | | 20 |
| 179 | AUS1194 | G | C | A | G | A | g | g | t | g | A | b | g | t | g | b | A | G | U | G | C | | | 20 |

FIG. 21

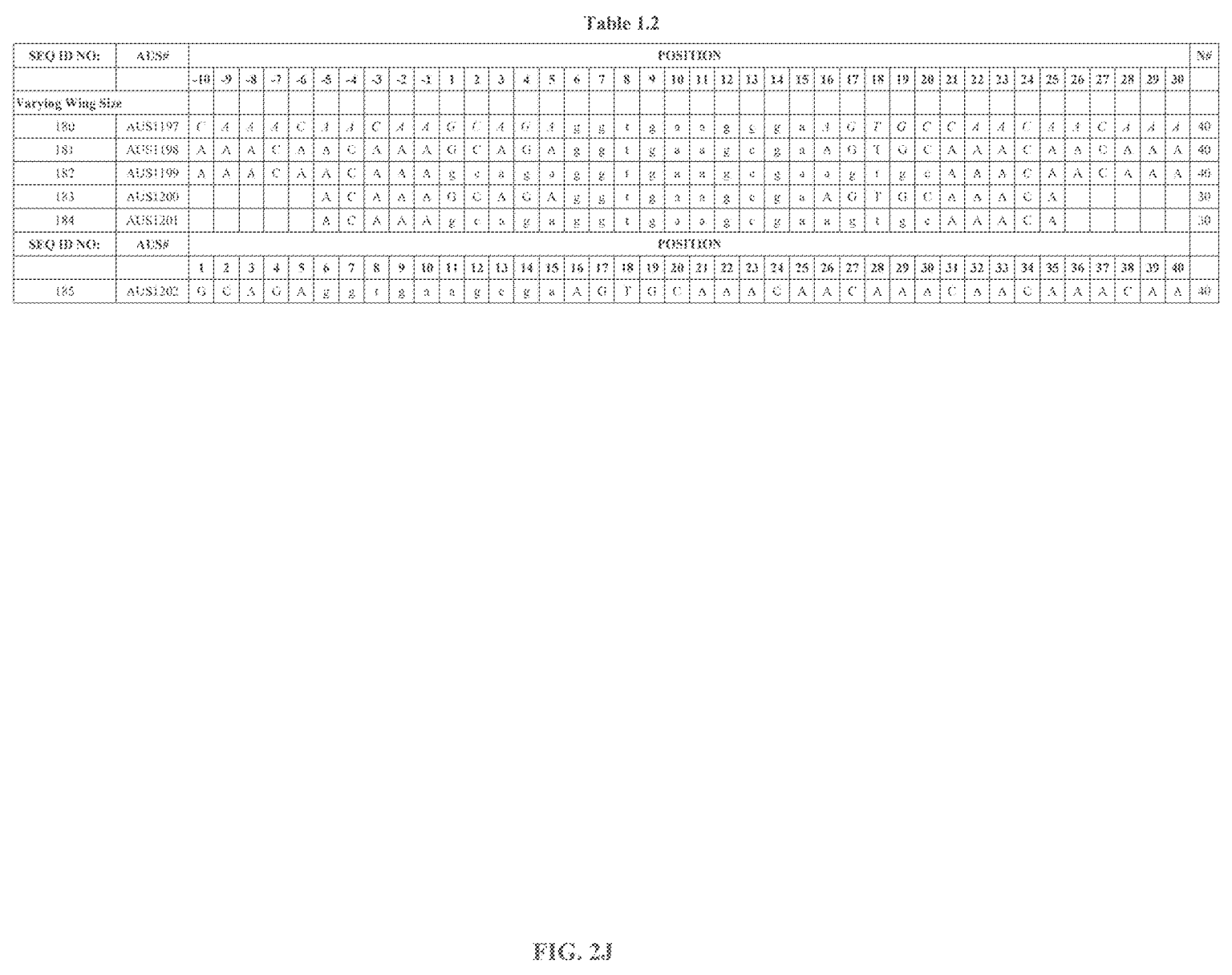

Table 1.2

| SEQ ID NO: | ADS# | POSITION | | | | | | | | | | | | | | | | | | | | | | | | | | | | | | | | | | | | | | | N |
|---|---|---|---|---|---|---|---|---|---|---|---|---|---|---|---|---|---|---|---|---|---|---|---|---|---|---|---|---|---|---|---|---|---|---|---|---|---|---|---|---|---|
| | | -10 | -9 | -8 | -7 | -6 | -5 | -4 | -3 | -2 | -1 | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | |
| Varying Wing Size | | | | | | | | | | | | | | | | | | | | | | | | | | | | | | | | | | | | | | | | | | | |
| 180 | AdS1197 | | | | | | | | | | | | | | | | | | | | | | | | | | | | | | | | | | | | | | | | | 40 |
| 181 | AdS1198 | | | | | | | | | | | | | | | | | | | | | | | | | | | | | | | | | | | | | | | | | 40 |
| 182 | AdS1199 | | | | | | | | | | | | | | | | | | | | | | | | | | | | | | | | | | | | | | | | | 40 |
| 183 | AdS1200 | | | | | | | | | | | | | | | | | | | | | | | | | | | | | | | | | | | | | | | | | 30 |
| 184 | AdS1201 | | | | | | | | | | | | | | | | | | | | | | | | | | | | | | | | | | | | | | | | | 30 |

| SEQ ID NO: | ADS# | POSITION | | | | | | | | | | | | | | | | | | | | | | | | | | | | | | | | | | | | | | | N |
|---|---|---|---|---|---|---|---|---|---|---|---|---|---|---|---|---|---|---|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | |
| 185 | AdS1202 | | | | | | | | | | | | | | | | | | | | | | | | | | | | | | | | | | | | | | | | | 40 |

FIG. 2J

Table 1.2

FIG. 2K

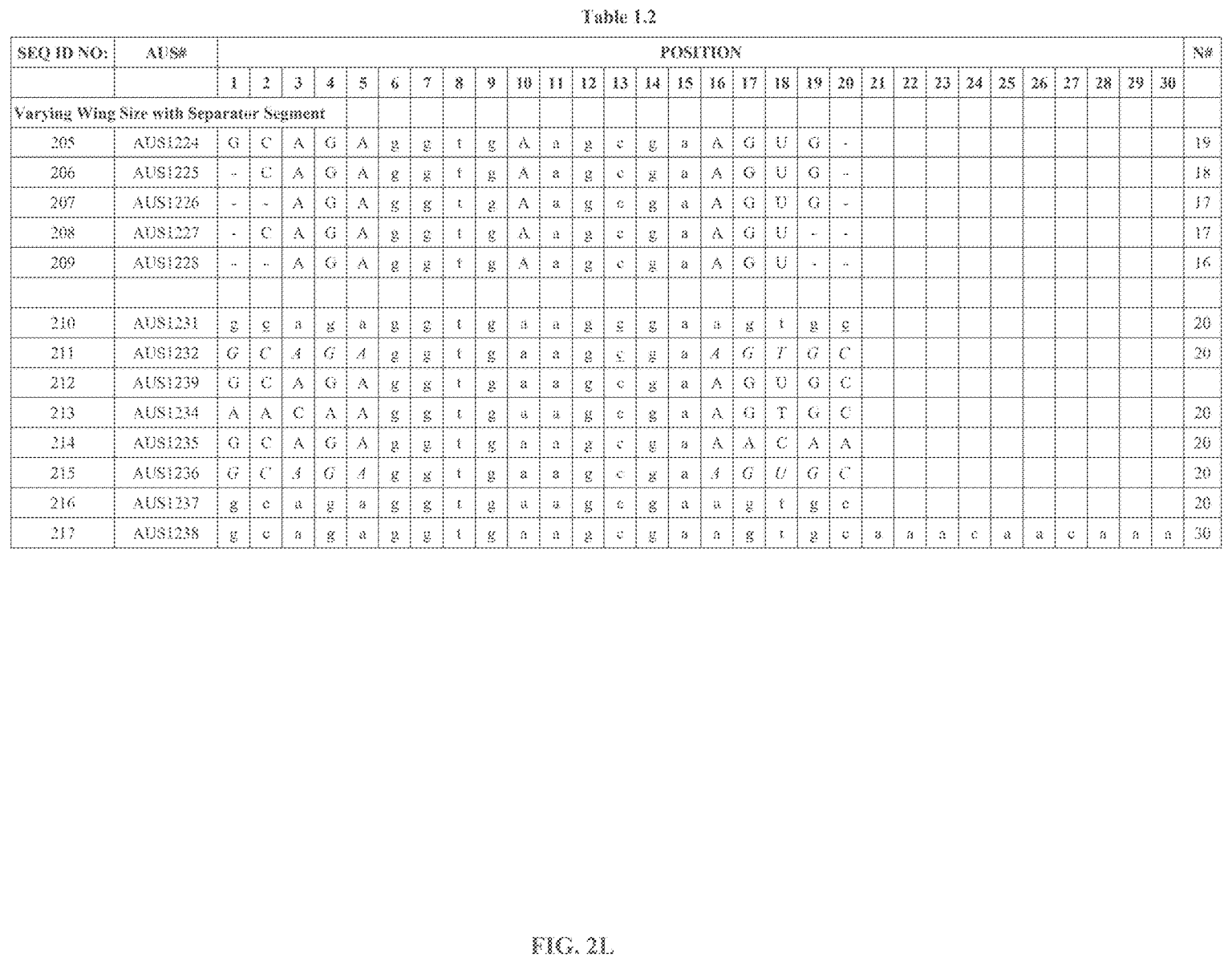

Table 1.2

| SEQ ID NO: | AUS# | POSITION | | | | | | | | | | | | | | | | | | | | | | | | | | | | | | N# |
|---|---|---|---|---|---|---|---|---|---|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | |
| Varying Wing Size with Separator Segment | | | | | | | | | | | | | | | | | | | | | | | | | | | | | | | | |
| 205 | AUS1224 | G | C | A | G | A | g | g | t | g | A | a | g | c | g | a | A | G | U | G | - | | | | | | | | | | | 19 |
| 206 | AUS1225 | - | C | A | G | A | g | g | t | g | A | a | g | c | g | a | A | G | U | G | - | | | | | | | | | | | 18 |
| 207 | AUS1226 | - | - | A | G | A | g | g | t | g | A | a | g | c | g | a | A | G | U | G | - | | | | | | | | | | | 17 |
| 208 | AUS1227 | - | C | A | G | A | g | g | t | g | A | a | g | c | g | a | A | G | U | - | - | | | | | | | | | | | 17 |
| 209 | AUS1228 | - | - | A | G | A | g | g | t | g | A | a | g | c | g | a | A | G | U | - | - | | | | | | | | | | | 16 |
| | | | | | | | | | | | | | | | | | | | | | | | | | | | | | | | | |
| 210 | AUS1231 | g | c | a | g | a | g | g | u | g | a | a | g | c | g | a | a | g | t | g | g | a | a | a | c | a | a | c | a | a | a | a | 20 |
| 211 | AUS1232 | G | C | A | G | A | g | g | u | g | a | a | g | u | g | a | A | G | T | C | C | | | | | | | | | | | 20 |
| 212 | AUS1239 | G | C | A | G | A | g | g | u | g | a | a | g | c | g | a | A | G | U | G | C | | | | | | | | | | | |
| 213 | AUS1234 | A | A | C | A | A | g | g | u | g | a | a | g | c | g | a | A | G | T | G | C | | | | | | | | | | | 20 |
| 214 | AUS1235 | G | C | A | G | A | g | g | u | g | a | a | g | c | g | a | A | A | C | A | A | | | | | | | | | | | 20 |
| 215 | AUS1236 | G | C | A | G | A | g | g | u | g | a | a | g | c | g | a | A | G | U | G | C | | | | | | | | | | | 20 |
| 216 | AUS1237 | g | c | a | g | a | g | g | u | g | a | a | g | c | g | a | a | g | t | g | c | | | | | | | | | | | 20 |
| 217 | AUS1238 | g | c | a | g | a | g | g | u | g | a | a | g | c | g | a | a | g | t | g | c | a | a | a | c | a | a | c | a | a | a | a | 30 |

FIG. 2L

Table 1.2

| SEQ ID NO: | ATB# | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | N# |
|---|---|---|---|---|---|---|---|---|---|---|---|---|---|---|---|---|---|---|---|---|---|---|---|---|---|---|---|---|---|---|---|---|---|---|---|---|---|---|---|---|---|---|
| 218 | AUS1241 | G | C | A | G | A | G | G | T | S | G | G | G | C | G | S | A | G | T | G | C | | | | | | | | | | | | | | | | | | | | | 20 |
| 219 | AUS1242 | G | C | A | C | A | G | G | T | S | A | G | G | C | G | S | A | G | T | G | C | | | | | | | | | | | | | | | | | | | | | 29 |
| 220 | AUS1243 | G | C | A | G | A | G | G | T | S | G | G | G | C | G | S | A | G | T | G | C | | | | | | | | | | | | | | | | | | | | | 28 |
| 221 | AUS1244 | G | C | A | G | A | G | G | T | S | A | G | G | C | G | S | A | G | T | G | C | | | | | | | | | | | | | | | | | | | | | 20 |
| 222 | AUS1245 | G | C | C | G | A | G | G | T | S | A | G | G | C | G | S | A | G | T | G | C | | | | | | | | | | | | | | | | | | | | | 29 |
| 223 | AUS1246 | G | C | A | G | A | G | G | T | S | A | G | G | C | G | S | A | G | T | G | C | | | | | | | | | | | | | | | | | | | | | 28 |
| 224 | AUS1247 | G | C | A | G | A | G | S | T | S | G | G | G | C | G | S | A | G | T | G | C | | | | | | | | | | | | | | | | | | | | | 28 |
| 225 | AUS1248 | G | C | A | G | A | G | G | T | S | G | G | G | C | G | S | C | G | C | G | C | A | A | C | A | C | A | A | C | A | C | A | A | C | A | C | | C | C | A | C | 40 |
| 226 | AUS1249 | G | C | A | G | A | G | G | T | S | G | G | G | C | G | S | A | G | C | G | C | | | | | | | | | | | | | | | | | | | | | 29 |
| 227 | AUS1250 | G | C | A | G | A | G | G | T | S | G | G | G | C | G | S | A | G | C | G | C | | | | | | | | | | | | | | | | | | | | | 28 |
| 228 | AUS1251 | G | C | A | G | A | G | G | T | S | G | G | G | C | G | S | A | G | C | G | C | | | | | | | | | | | | | | | | | | | | | 28 |
| 229 | AUS1252 | G | C | A | G | A | G | G | T | S | G | G | G | C | G | S | A | G | T | G | C | | | | | | | | | | | | | | | | | | | | | 29 |
| 230 | AUS1253 | G | C | A | G | A | G | G | T | S | G | G | G | C | G | S | A | G | T | G | C | | | | | | | | | | | | | | | | | | | | | 28 |
| 231 | AUS1254 | G | C | A | G | A | G | G | T | S | G | G | G | C | G | S | A | G | T | G | C | | | | | | | | | | | | | | | | | | | | | 28 |
| 232 | AUS1255 | G | C | C | G | A | G | G | T | S | G | G | G | C | G | S | A | G | T | G | C | | | | | | | | | | | | | | | | | | | | | 29 |
| 233 | AUS1256 | G | C | A | G | A | G | G | T | S | G | G | G | C | G | S | A | G | T | G | C | | | | | | | | | | | | | | | | | | | | | 28 |
| 234 | AUS1257 | G | C | C | G | A | G | G | T | S | G | G | G | C | G | S | A | G | T | G | C | | | | | | | | | | | | | | | | | | | | | 20 |
| 235 | AUS1258 | G | C | A | G | A | G | G | T | S | G | G | G | C | G | S | A | G | T | G | C | | | | | | | | | | | | | | | | | | | | | 29 |
| 236 | AUS1259 | G | C | A | G | A | G | G | T | S | G | G | G | C | G | S | A | G | T | G | C | | | | | | | | | | | | | | | | | | | | | 28 |
| 237 | AUS1260 | G | C | A | G | A | G | G | T | S | G | G | G | C | G | S | A | G | T | G | C | | | | | | | | | | | | | | | | | | | | | 20 |

FIG. 2M

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 238 | AUS1261 | +G | C | A | G | A | g | g | t | g | a | a | g | c | g | a | A | G | U | G | C | 20 |
| 239 | AUS1262 | +G | +C | A | G | A | g | g | t | g | a | a | g | c | g | a | A | G | U | G | C | 20 |
| 240 | AUS1263 | +G | +C | +A | G | A | g | g | t | g | a | a | g | c | g | a | A | G | U | G | C | 20 |
| 241 | AUS1264 | +G | +C | +A | +G | A | g | g | t | g | a | a | g | c | g | a | A | G | U | G | C | 20 |
| 242 | AUS1266 | G | G | A | G | A | g | g | t | g | a | a | g | c | g | a | A | G | T | G | C | 20 |
| 243 | AUS1267 | G | C | T | G | A | g | g | t | g | a | a | g | c | g | a | A | G | T | G | C | 20 |
| 244 | AUS1268 | G | C | A | C | A | c | g | t | g | a | a | g | c | g | a | A | G | T | G | C | 20 |
| 245 | AUS1269 | G | C | A | G | T | g | g | t | g | a | a | g | c | g | a | A | G | T | G | C | 20 |
| 246 | AUS1270 | G | C | A | G | A | g | c | t | g | a | a | g | c | g | a | A | G | T | G | C | 20 |
| 247 | AUS1271 | G | C | A | G | A | g | g | t | g | a | a | g | c | g | a | A | G | U | G | C | 20 |
| 248 | AUS1272 | C | C | A | G | A | g | g | t | g | a | a | g | c | g | a | A | G | U | G | C | 20 |
| 249 | AUS1274 | G" | C" | A" | G" | A" | g | g | t | g | a | a | g | c | g | a | A | G | T | G | C | 20 |
| 250 | AUS1275 | G | C | A" | G" | A" | g | g | t | g | a | a | g | c | g | a | A | G | T | G | C | 20 |
| 251 | AUS1277 | +G | +C | A | G | A | g | g | t | g | a | a | g | c | g | a | A | G | T | G | C | 20 |
| 252 | AUS1278 | +G | C | +A | G | A | g | g | t | g | a | a | g | c | g | a | A | G | T | G | C | 20 |
| 253 | AUS1279 | +G | C | A | +G | +A | g | g | t | g | a | a | g | c | g | a | A | G | T | G | C | 20 |
| 254 | AUS1280 | +G | C | A | G | A | g | g | t | g | a | a | g | c | g | a | A | G | T | G | C | 20 |
| 255 | AUS1281 | G | +C | A | G | A | g | g | t | g | a | a | g | c | g | a | A | G | T | G | C | 20 |
| 256 | AUS1282 | G | +C | +A | +G | A | g | g | t | g | a | a | g | c | g | a | A | G | T | G | C | 20 |
| 257 | AUS1283 | G | +C | A | G | +A | g | g | t | g | a | a | g | c | g | a | A | G | T | G | C | 20 |

FIG. 2N

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 258 | AUS1284 | G | C | +A | +G | A | g | g | t | g | a | a | g | c | g | a | A | G | T | G | C | |
| 259 | AUS1285 | G | C | +A | G | +A | g | g | t | g | a | a | g | c | g | a | A | G | T | G | C | 20 |
| 260 | AUS1286 | G | C | A | +G | +A | g | g | t | g | a | a | g | c | g | a | A | G | T | G | C | 20 |
| 261 | AUS1287 | +G | +C | +A | G | A | g | g | t | g | a | a | g | c | g | a | A | G | T | G | C | 20 |
| 262 | AUS1288 | +G | +C | A | +G | A | g | g | t | g | a | a | g | c | g | a | A | G | T | G | C | 20 |
| 263 | AUS1289 | +G | +C | A | G | +A | g | g | t | g | a | a | g | c | g | a | A | G | T | G | C | 20 |
| 264 | AUS1290 | +G | C | +A | G | A | g | g | t | g | a | a | g | c | g | a | A | G | T | G | C | 20 |
| 265 | AUS1291 | +G | C | +A | +G | +A | g | g | t | g | a | a | g | c | g | a | A | G | T | G | C | 20 |
| 266 | AUS1292 | +G | C | A | +G | +A | g | g | t | g | a | a | g | c | g | a | A | G | T | G | C | 20 |
| 267 | AUS1293 | G | +C | +A | G | A | g | g | t | g | a | a | g | c | g | a | A | G | T | G | C | 20 |
| 268 | AUS1294 | G | +C | +A | +G | +A | g | g | t | g | a | a | g | c | g | a | A | G | T | G | C | 20 |
| 269 | AUS1295 | G | +C | A | +G | +A | g | g | t | g | a | a | g | c | g | a | A | G | T | G | C | 20 |
| 270 | AUS1296 | G | C | +A | +G | +A | g | g | t | g | a | a | g | c | g | a | A | G | T | G | C | 20 |
| 271 | AUS1298 | G | c | A | G | A | G | g | t | g | a | A | g | c | g | a | A | G | T | G | C | 20 |
| 272 | AUS1299 | G | c | A | g | A | G | g | t | g | a | A | g | c | g | a | A | G | T | G | C | 20 |
| 273 | AUS1300 | G | g | A | G | A | G | g | t | g | a | A | g | c | g | a | A | G | T | G | C | 20 |
| 274 | AUS1301 | G | g | A | g | A | G | g | t | g | a | A | g | c | g | a | A | G | T | G | C | 20 |
| 275 | AUS1302 | +G | C | A | G | A | G | g | t | g | a | A | g | c | g | a | A | G | T | G | C | 20 |
| 276 | AUS1303 | G | +C | +A | +G | A | G | g | t | g | a | A | g | c | g | a | A | G | T | G | C | 20 |
| 277 | AUS1304 | G | C | A | G | A | G | g | t | g | a | A | g | c | g | a | A | G | T | G | C | 20 |
| 278 | AUS1305 | G | C | A | G | A | G | g | t | g | a | A | g | c | g | a | A | G | T | G | C | 20 |
| 279 | AUS1306 | G | C | A | G | +A | G | g | t | g | a | A | g | c | g | a | A | G | T | G | C | 20 |
| 280 | AUS1307 | +G | c | A | G | A | G | g | t | g | a | A | g | c | g | a | A | G | T | G | C | 20 |

POSITION

FIG. 20

Table 1.2

| SEQ ID NO: | AUS# | POSITION | | | | | | | | | | | | | | | | | | | | N# |
|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | |
| 281 | AUS1308 | G | c | +A | G | A | G | g | t | g | a | A | g | c | g | a | A | G | T | G | C | 20 |
| 282 | AUS1309 | G | c | A | +G | A | G | g | t | g | a | A | g | c | g | a | A | G | T | G | C | 20 |
| 283 | AUS1310 | G | c | A | G | +A | G | g | t | g | a | A | g | c | g | a | A | G | T | G | C | 20 |
| 284 | AUS1311 | +G | c | A | g | A | G | g | t | g | a | A | g | c | g | a | A | G | T | G | C | 20 |
| 285 | AUS1312 | G | c | +A | g | A | G | g | t | g | a | A | g | c | g | a | A | G | T | G | C | 20 |
| 286 | AUS1313 | G | c | A | g | +A | G | g | t | g | a | A | g | c | g | a | A | G | T | G | C | 20 |
| 287 | AUS1314 | +G | c | A | G | A | g | g | t | g | A | B | g | c | g | A | A | G | T | G | C | 20 |
| 288 | AUS1315 | G | c | +A | G | A | g | g | t | g | A | B | g | c | g | A | A | G | T | G | C | 20 |
| 289 | AUS1316 | G | c | A | g | A | g | g | t | g | A | B | g | c | g | A | A | G | T | G | C | 20 |
| 290 | AUS1317 | +G | c | A | g | +A | g | g | t | g | A | B | g | c | g | A | A | G | T | G | C | 20 |
| 291 | AUS1318 | G | c | A | g | A | g | g | t | g | A | B | g | c | g | A | A | G | T | G | C | 20 |
| 292 | AUS1319 | +G | c | A | G | A | g | g | t | g | A | B | g | c | g | A | A | G | T | G | C | 20 |
| 293 | AUS1320 | G | c | A | G | +A | g | g | t | g | A | B | g | c | g | A | A | G | T | G | C | 20 |
| 294 | AUS1322 | +G | +C | +A | G | A | g | g | t | g | a | B | g | c | g | a | A | G | T | G | C | 20 |
| 295 | AUS1323 | +G | C | A | G | +A | g | g | t | g | a | B | g | c | g | a | A | G | T | G | C | 20 |
| 296 | AUS1324 | +G | C | A | G | A | g | g | t | g | a | B | g | c | g | a | A | G | U | G | C | 20 |
| 297 | AUS1325 | +G | C | +A | +G | A | g | g | t | g | A | B | g | c | g | a | A | G | U | G | C | 20 |
| 298 | AUS1326 | +G | +C | A | +G | A | g | g | t | g | A | B | g | c | g | a | A | G | U | G | C | 20 |
| 299 | AUS1327 | +G | +C | +A | G | A | g | g | t | g | A | B | g | c | g | a | A | G | U | G | C | 20 |
| 300 | AUS1328 | G | +C | A | +G | A | g | g | t | g | A | B | g | c | g | a | A | G | U | G | C | 20 |
| 301 | AUS1329 | +G | C | +A | G | +A | g | g | t | g | A | B | g | c | g | a | A | G | U | G | C | 20 |

FIG. 2P

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| | Wing Modification: 3' modification | | | | | | | | | | | | | | | | | | | | | |
| 302 | AUS1332 | G | C | A | G | A | g | g | t | g | a | a | g | c | g | a | +A | +G | +T | +G | +C | 20 |
| 303 | AUS1333 | G | C | G | A | A | g | t | g | c | a | c | a | c | g | g | U' | C | C | G | G | 20 |
| 304 | AUS1334 | G | C | A | G | A | g | g | t | g | a | a | g | c | g | a | A' | G | U | G | C | 20 |
| 305 | AUS1335 | G | C | A | G | A | g | g | t | g | a | a | g | c | g | a | +A | G | U | G | C | 20 |
| 306 | AUS1336 | G | C | A | G | A | g | g | t | g | a | a | g | c | g | a | +A | +G | U | G | C | 20 |
| 307 | AUS1337 | G | C | A | G | A | g | g | t | g | a | a | g | c | g | a | +A | +G | +T | G | C | 20 |
| 308 | AUS1338 | G | C | A | G | A | g | g | t | g | a | a | g | c | g | a | +A | +G | +T | +G | C | 20 |
| | | | | | | | | | | | | | | | | | | | | | | |
| 309 | AUS1340 | G | C | A | G | A | G | g | t | g | a | A | g | c | g | a | +A | +G | +T | G | C | 20 |
| 310 | AUS1341 | G | C | A | G | A | G | g | t | g | a | A | g | c | g | a | +A | +G | T | +G | C | 20 |
| 311 | AUS1342 | G | C | A | G | A | G | g | t | g | a | A | g | c | g | a | +A | +G | T | G | +C | 20 |
| 312 | AUS1343 | G | C | A | G | A | G | g | t | g | a | A | g | c | g | a | +A | G | +T | G | C | 20 |
| 313 | AUS1344 | G | C | A | G | A | G | g | t | g | a | A | g | c | g | a | +A | G | +T | G | +C | 20 |
| 314 | AUS1345 | G | C | A | G | A | G | g | t | g | a | A | g | c | g | a | +A | G | T | +G | +C | 20 |
| 315 | AUS1346 | G | C | A | G | A | G | g | t | c | a | A | g | c | g | a | A | +G | +T | +G | C | 20 |

POSITION

FIG. 2Q

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 316 | AUS1347 | G | C | A | G | A | G | g | t | g | a | A | g | c | g | a | A | +G | +T | G | +C | 20 |
| 317 | AUS1348 | G | C | A | G | A | G | g | t | g | a | A | g | c | g | a | A | +G | T | +G | +C | 20 |
| 318 | AUS1349 | G | C | A | G | A | G | g | t | g | a | A | g | c | g | a | A | G | +T | +G | +C | 20 |
| 319 | AUS1350 | G | C | A | G | A | g | g | t | g | A | a | g | c | g | A | +A | +G | +T | G | C | 20 |
| 320 | AUS1351 | G | C | A | G | A | g | g | t | g | A | a | g | c | g | A | +A | +G | T | +G | C | 20 |
| 321 | AUS1352 | G | C | A | G | A | g | g | t | g | A | a | g | c | g | A | +A | +G | T | G | +C | 20 |
| 322 | AUS1353 | G | C | A | G | A | g | g | t | g | A | a | g | c | g | A | +A | G | +T | +G | C | 20 |
| 323 | AUS1354 | G | C | A | G | A | g | g | t | g | A | a | g | c | g | A | +A | G | +T | G | +C | 20 |
| 324 | AUS1355 | G | C | A | G | A | g | g | t | g | A | a | g | c | g | A | +A | G | T | +G | +C | 20 |
| 325 | AUS1356 | G | C | A | G | A | g | g | t | g | A | a | g | c | g | A | A | +G | +T | +G | C | 20 |
| 326 | AUS1357 | G | C | A | G | A | g | g | t | g | A | a | g | c | g | A | A | +G | +T | G | +C | 20 |
| 327 | AUS1358 | G | C | A | G | A | g | g | t | g | A | a | g | c | g | A | A | +G | T | +G | +C | 20 |
| 328 | AUS1359 | G | C | A | G | A | g | g | t | g | A | a | g | c | g | A | +A | G | +T | +G | +C | 20 |
| 329 | AUS1360 | G | C | A | G | A | g | g | t | g | A | a | g | c | g | a | A | +G | U | G | C | 20 |
| 330 | AUS1361 | G | C | A | G | A | g | g | t | g | A | a | g | c | g | a | A | +G | U | +G | +C | 20 |
| 331 | AUS1362 | G | C | A | G | A | g | g | t | g | A | a | g | c | g | a | A | +G | +T | +G | C | 20 |

FIG. 2R

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| | | | | | | | | | | | | | | | POSITION | | | | | | | |
| 5' Wing and 3' Wing Modifications with Separator Segments | | | | | | | | | | | | | | | | | | | | | | |
| 332 | AUS1365 | +G | +C | +A | +G | +A | g | g | t | g | a | a | g | c | g | a | +A | +G | +T | +G | +C | |
| 333 | AUS1366 | +G | +C | A | G | A | G | G | T | G | A | A | G | C | G | A | A | G | T | +G | +C | 20 |
| 334 | AUS1367 | +G | C | +A | G | A | g | g | t | g | a | a | g | c | g | a | A | G | U | G | C | |
| 335 | AUS1368 | +G | C | +A | +G | A | g | g | t | g | a | a | g | c | g | a | A | A | U | G | C | 20 |
| 336 | AUS1370 | +G | c | +A | G | A | G | g | t | g | a | A | g | c | g | a | +A | +G | U | G | C | 20 |
| 337 | AUS1371 | +G | c | +A | g | A | G | g | t | g | a | A | g | c | g | a | +A | +G | U | G | C | 20 |
| 338 | AUS1372 | +G | c | +A | G | A | g | g | t | g | A | a | g | c | g | A | +A | +G | U | G | C | 20 |
| 339 | AUS1373 | +G | c | +A | g | A | g | g | t | g | A | A | g | c | g | A | +A | +G | U | G | C | 20 |
| 340 | AUS1374 | G | c | +A | G | A | G | g | t | g | a | A | g | c | g | a | +A | G | U | G | C | 20 |
| 341 | AUS1375 | G | c | +A | G | A | G | g | t | g | a | a | g | c | g | a | +A | G | D | G | C | 20 |
| 342 | AUS1376 | G | C | +A | G | A | G | g | t | g | a | a | g | c | g | a | +A | G | +T | G | +C | 20 |
| 343 | AUS1377 | G | c | +A | g | A | G | g | t | g | a | a | g | c | g | a | +A | G | +T | G | +C | 20 |
| 344 | AUS1378 | G | c | +A | G | A | g | g | t | g | A | a | g | c | g | A | +A | +G | +T | G | +C | 20 |
| 345 | AUS1379 | G | c | +A | G | A | g | g | t | g | A | a | g | c | g | A | +A | G | +T | G | +C | 20 |

FIG. 28

Table L2

5' Wing and 3' Wing Modifications with Separator Segments

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 346 | AUS1382 | +G | +C | A | +G | A | g | g | t | g | A | a | g | c | g | a | a | G | T | G | C | 20 |
| 347 | AUS1383 | +G | +C | A | +G | a | g | g | t | g | A | a | g | c | g | a | A | G | T | G | C | 20 |
| 348 | AUS1384 | +G | +C | A | +G | a | g | g | t | g | A | a | g | c | g | a | a | G | T | G | C | 20 |
| 349 | AUS1385 | +G | C | +A | +G | A | g | g | t | g | A | a | g | c | g | a | a | G | T | G | C | 20 |
| 350 | AUS1387 | +G | C | +A | G | A | g | g | t | g | A | a | g | c | g | a | A | G | U | G | C | 20 |
| 351 | AUS1388 | +G | C | +A | G | A | g | g | t | g | A | a | g | c | g | a | a | G | U | G | C | 20 |
| 352 | AUS1389 | +G | C | +A | G | A | g | g | t | g | A | a | g | c | g | a | a | g | U | +G | +C | 20 |
| 353 | AUS1390 | +G | C | +A | G | A | g | g | t | g | A | a | g | c | g | a | a | G | U | G | C | 20 |
| 354 | AUS1391 | +G | C | +A | G | A | g | g | t | g | A | a | g | c | g | a | a | g | U | G | C | 20 |
| 355 | AUS1392 | +G | C | +A | G | A | g | g | t | g | A | a | g | c | g | a | a | g | U | +G | +C | 20 |
| 356 | AUS1393 | +G | C | +A | G | A | g | g | t | g | A | a | g | c | g | a | a | g | U | +G | +C | 20 |
| 357 | AUS1394 | +G | C | +A | G | A | g | g | t | g | A | a | g | c | g | a | a | g | U | G | +C | 20 |
| 358 | AUS1395 | +G | C | A | G | A | g | g | t | g | A | a | g | c | g | a | a | g | U | +G | C | 20 |
| 359 | AUS1396 | +G | +C | A | G | A | g | g | t | g | A | a | g | c | g | a | a | g | U | +G | +C | 20 |
| 360 | AUS1397 | +G | +C | A | G | A | g | g | t | g | A | a | g | c | g | a | a | g | U | +G | C | 20 |
| 361 | AUS1398 | +G | +C | A | G | A | g | g | t | t | A | a | g | c | g | a | a | g | U | +G | +C | 20 |
| 362 | AUS1399 | +G | +C | A | G | A | g | g | t | g | A | a | g | c | g | a | a | g | U | G | +C | 20 |
| 363 | AUS1400 | G | C | A | G | A | g | g | t | g | A | a | g | c | g | a | a | g | U | G | +C | 20 |
| 364 | AUS1401 | G | c | +A | G | A | g | g | t | g | A | a | g | c | g | a | a | g | U | +G | +C | 20 |
| 365 | AUS1402 | +G | c | +A | G | A | g | g | t | g | A | a | g | c | g | a | a | g | U | +G | +C | 20 |
| 366 | AUS1403 | +G | c | +A | G | A | g | g | t | g | A | a | g | c | g | a | a | g | U | G | C | 20 |
| 367 | AUS1404 | +G | c | +A | G | A | g | g | t | t | A | a | g | c | g | a | a | g | U | G | C | 20 |

POSITION

FIG. 2T

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| | | | | | | | | | | | | | | | | POSITION | | | | | | |
| 368 | AUS1405 | +G | c | +A | G | A | g | g | t | g | A | a | g | c | g | a | a | g | U | G | +C | 20 |
| 369 | AUS1406 | +G | c | +A | G | A | g | g | t | g | A | a | g | c | g | a | a | g | U | +G | +C | 20 |
| 370 | AUS1407 | G | c | +A | +G | A | g | g | t | g | A | a | g | c | g | a | a | g | U | +G | +C | 20 |
| 371 | AUS1408 | G | +C | +A | G | A | g | g | t | g | A | a | g | c | g | a | a | g | U | +G | +C | 20 |
| 372 | AUS1409 | +G | +C | A | +G | A | g | g | t | g | A | a | g | c | g | a | a | G | U | G | C | 20 |
| 373 | AUS1410 | +G | +C | A | +G | A | g | g | t | g | A | a | g | c | g | a | a | g | U | G | C | 20 |
| 374 | AUS1411 | +G | +C | A | +G | A | g | g | t | g | A | a | g | c | g | a | a | g | U | G | +C | 20 |
| 375 | AUS1412 | +G | +C | A | +G | A | g | g | t | g | A | a | g | c | g | a | a | g | U | G | +C | 20 |
| 376 | AUS1413 | +G | +C | A | +G | A | g | g | t | g | A | a | g | c | g | a | a | g | U | G | C | 20 |
| 377 | AUS1414 | +G | +C | A | +G | A | g | g | t | g | A | a | g | c | g | a | a | g | U | G | +C | 20 |
| 378 | AUS1415 | +G | c | +A | +G | A | g | g | t | g | A | a | g | c | g | a | a | G | U | G | C | 20 |
| 379 | AUS1416 | +G | c | +A | +G | A | g | g | t | g | A | a | g | c | g | a | a | g | U | G | C | 20 |
| 380 | AUS1417 | +G | c | +A | +G | A | g | g | t | g | A | a | g | c | g | a | a | g | U | G | +C | 20 |
| 381 | AUS1418 | - | - | G | T | C | - | - | - | g | c | c | - | - | - | c | T | C | t | - | - | 16 |
| 382 | AUS1419 | - | - | +G | +T | +C | - | - | - | c | c | c | - | - | - | c | +T | +C | C | - | - | 16 |
| 383 | AUS1420 | - | G | C | - | c | a | a | a | c | c | a | g | c | a | g | g | c | +C | A | - | 18 |
| 384 | AUS1421 | - | +G | +C | - | c | a | a | a | c | c | a | g | c | a | g | g | c | +C | +A | - | 18 |
| 385 | AUS1422 | G | C | A | G | A | g | g | t | g | A | a | g | c | g | a | A | G | T | +G | +C | 20 |

FIG. 2U

Table L2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 386 | AUS1423 | G | C | A | G | A | g | g | t | g | A | a | g | c | g | a | A | G | +T | G | +C | 20 |
| 387 | AUS1424 | G | C | A | G | A | g | g | t | g | A | a | g | c | g | a | A | +G | T | G | +C | 20 |
| 388 | AUS1425 | G | C | A | G | A | g | g | t | g | A | a | g | c | g | a | A | G | +T | +G | C | 20 |
| 389 | AUS1426 | G | C | A | G | A | g | g | t | g | A | a | g | c | g | a | A | +G | T | +G | C | 20 |
| 390 | AUS1427 | G | C | A | G | A | g | g | t | g | A | a | g | c | g | a | A | +G | +T | G | C | 20 |
| 391 | AUS1428 | G | C | A | G | A | g | g | t | g | A | a | g | c | g | a | A | G | T | +G | +C | 20 |
| 392 | AUS1429 | G | C | A | G | A | g | g | t | g | A | a | g | c | g | a | a | G | T | +G | +C | 20 |
| 393 | AUS1430 | G | C | A | G | A | g | g | t | g | A | a | g | c | g | a | A | G | T | +G | +C | 20 |
| 394 | AUS1431 | G | C | A | G | a | g | g | t | g | A | a | g | c | g | a | a | G | T | +G | +C | 20 |
| 395 | AUS1432 | G | C | +A | G | A | g | g | t | g | A | a | g | c | g | a | a | G | T | +G | +C | 20 |
| 396 | AUS1433 | +G | c | +A | G | a | g | g | t | g | A | a | g | c | g | a | a | G | T | G | C | 20 |
| 397 | AUS1434 | +G | C | +A | G | A | g | g | t | g | A | a | g | c | g | a | A | G | T | G | C | 20 |
| 398 | AUS1435 | +G | C | +A | G | A | g | g | t | g | A | a | g | c | g | a | A | G | T | G | C | 20 |
| 399 | AUS1436 | +G | C | +A | G | A | g | g | t | g | A | a | g | c | g | a | A | G | T | G | C | 20 |
| 400 | AUS1437 | +G | C | +A | G | A | g | g | t | g | A | a | g | c | g | a | a | G | T | G | C | 20 |
| 401 | AUS1438 | +G | C | +A | G | A | g | g | t | g | A | a | g | c | g | a | A | G | T | G | C | 20 |
| 402 | AUS1439 | +G | c | +A | G | A | g | g | t | g | A | a | g | c | g | a | a | G | T | G | C | 20 |
| 403 | AUS1440 | +G | c | +A | G | A | g | g | t | g | A | a | g | c | g | a | A | G | T | G | C | 20 |
| 404 | AUS1441 | +G | C | A | G | A | g | g | t | g | A | a | g | c | g | a | A | G | T | G | C | 20 |
| 405 | AUS1442 | G | C | +A | g | A | g | g | t | g | A | a | g | c | g | a | A | G | T | G | C | 20 |
| 406 | AUS1443 | +G | C | +A | g | A | g | g | t | g | A | a | g | c | g | a | A | G | T | G | C | 20 |
| 407 | AUS1444 | +G | c | +A | g | A | g | g | t | g | A | a | g | c | g | a | A | G | T | G | C | 20 |

POSITION

FIG. 2V

Table 1.2

| SEQ ID NO: | AUS# | \ POSITION | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|---|
| 408 | AUS1445 | | +G | C | +A | g | a | g | g | t | g | A | a | g | c | g | a | A | G | T | G | C | 20 |
| 409 | AUS1446 | | G | C | A | G | A | g | g | t | g | A | a | g | c | g | A | A | G | T | G | C | 20 |
| 410 | AUS1447 | | G | C | A | G | a | g | g | t | g | A | a | g | c | g | A | A | G | T | G | C | 20 |
| 411 | AUS1448 | | G | C | A | G | A | g | g | t | g | A | a | g | c | g | A | A | G | T | G | C | 20 |
| 412 | AUS1449 | | G | C | A | g | A | g | g | t | g | A | a | g | c | g | A | A | G | T | G | C | 20 |
| 413 | AUS1450 | | G | C | A | G | A | g | g | t | g | A | a | g | c | g | A | A | G | T | G | C | 20 |
| 414 | AUS1451 | | G | C | A | G | A | g | g | t | g | A | a | g | c | g | a | A | G | T | G | C | 20 |
| 415 | AUS1452 | | G | C | A | G | A | g | g | t | g | A | a | g | c | g | a | A | G | T | G | C | 20 |
| 416 | AUS1453 | | G | C | A | g | A | g | g | t | g | A | a | g | c | g | a | A | G | T | G | C | 20 |
| 417 | AUS1454 | | G | C | A | G | A | g | g | t | g | A | a | g | c | g | A | A | G | T | G | C | 20 |
| 418 | AUS1455 | | G | C | A | G | a | g | g | t | g | A | a | g | c | g | a | a | G | T | G | C | 20 |
| 419 | AUS1456 | | G | C | A | G | a | g | g | t | g | A | a | g | c | g | a | a | G | T | G | C | 20 |
| 420 | AUS1457 | | G | C | A | G | A | g | g | t | g | A | a | g | c | g | a | a | G | T | G | C | 20 |
| 421 | AUS1458 | | G | C | A | G | A | g | g | t | g | A | a | g | c | g | a | +A | G | T | G | +C | 20 |
| 422 | AUS1459 | | G | C | A | G | A | g | g | t | g | A | a | g | c | g | a | +A | G | T | +G | C | 20 |
| 423 | AUS1460 | | G | C | A | G | A | g | g | t | g | A | a | g | c | g | a | +A | +G | +T | G | C | 20 |
| 424 | AUS1461 | | G | C | A | G | A | g | g | t | g | A | a | g | c | g | a | A | +G | +T | G | C | 20 |
| 425 | AUS1462 | | G | C | A | G | A | g | g | t | g | A | a | g | c | g | a | A | +G | +T | G | C | 20 |

FIG. 2W

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| | | | | | | | | | | | | | | | | | | | | | | POSITION | |
| 426 | AUS1463 | G | c | A | G | a | g | g | t | g | A | a | g | c | g | a | A | +G | +T | +G | +C | 20 |
| 427 | AUS1464 | G | c | A | G | a | g | g | t | g | A | a | g | c | g | a | A | +G | +T | G | +C | 20 |
| 428 | AUS1465 | G | c | A | G | A | g | g | t | g | A | a | g | c | g | a | A | +G | T | G | +C | 20 |
| 429 | AUS1466 | G | C | A | G | a | g | g | t | g | A | a | g | c | g | a | A | +G | T | G | +C | 20 |
| 430 | AUS1467 | G | c | A | G | a | g | g | t | g | A | a | g | c | g | a | A | +G | T | +G | +C | 20 |
| 431 | AUS1468 | G | C | A | G | a | g | g | t | g | A | a | g | c | g | a | A | +G | T | +G | C | 20 |
| 432 | AUS1469 | G | c | A | G | A | g | g | t | g | A | a | g | c | g | a | A | +G | +T | +G | C | 20 |
| 433 | AUS1470 | G | C | A | G | a | g | g | t | g | A | a | g | c | g | a | A | +G | +T | +G | C | 20 |
| 434 | AUS1471 | G | C | A | G | A | g | g | t | g | A | a | g | c | g | a | A | +G | +T | +G | +C | 20 |
| 435 | AUS1472 | G | C | A | g | A | g | g | t | g | A | a | g | c | g | a | A | +G | +T | +G | +C | 20 |
| 436 | AUS1473 | G | C | A | g | A | g | g | t | g | A | a | g | c | g | a | A | +G | +T | +G | +C | 20 |
| 437 | AUS1474 | G | C | A | G | A | g | g | t | g | A | a | g | c | g | a | A | +G | +T | +G | +C | 20 |
| 438 | AUS1475 | G | C | A | G | A | g | g | t | g | A | a | g | c | g | a | A | +G | T | +G | +C | 20 |
| 439 | AUS1476 | G | c | A | G | a | g | g | t | g | a | a | g | c | g | a | A | +G | T | +G | +C | 20 |
| 440 | AUS1477 | G | C | A | G | a | g | g | t | g | a | a | g | c | g | a | A | +G | T | +G | +C | 20 |
| 441 | AUS1478 | G | c | A | G | A | g | g | t | g | A | a | g | c | g | a | A | +G | +T | +G | C | 20 |
| 442 | AUS1479 | G | C | A | G | A | g | g | t | g | a | a | g | c | g | a | A | +G | +T | +G | C | 20 |
| 443 | AUS1480 | G | c | A | G | A | g | g | t | g | a | a | g | c | g | a | A | +G | +T | G | C | 20 |
| 444 | AUS1481 | G | C | A | G | a | g | g | t | g | a | a | g | c | g | a | A | +G | +T | +G | C | 20 |
| 445 | AUS1482 | G | C | A | G | A | g | g | t | g | a | a | g | c | g | a | A | +G | +T | +G | C | 20 |
| 446 | AUS1483 | G | c | A | G | a | g | g | t | g | a | a | g | c | g | a | A | +G | +T | +G | C | 20 |
| 447 | AUS1484 | G | C | A | G | a | g | g | t | g | A | a | g | c | g | a | A | G | T | G | C | 20 |

FIG. 2X

Table L2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 448 | AUS1485 | G | c | A | G | a | g | g | t | g | A | a | g | c | g | a | A | G | T | G | C | 20 |
| 449 | AUS1486 | G | C | a | G | A | g | g | t | g | A | a | g | c | g | a | A | G | T | G | C | 20 |
| 450 | AUS1487 | G | c | A | g | A | g | g | t | g | A | a | g | c | g | a | A | G | T | G | C | 20 |
| 451 | AUS1488 | G | c | A | G | a | g | g | t | g | A | a | g | c | g | A | A | +G | +T | G | C | 20 |
| 452 | AUS1489 | G | C | A | G | a | g | g | t | g | A | a | g | c | g | A | A | +G | +T | G | C | 20 |
| 453 | AUS1490 | G | C | A | G | A | g | g | t | g | A | a | g | c | g | A | A | +G | +T | G | C | 20 |
| 454 | AUS1491 | - | - | +G | +T | +C | t | g | t | g | c | a | t | c | t | c | +T | +C | ±C | - | - | 16 |
| 455 | AUS1492 | G | c | A | G | a | g | g | t | g | A | a | g | c | g | a | A | +G | +T | G | C | 20 |
| 456 | AUS1493 | G | C | A | G | a | g | g | t | g | A | a | g | c | g | a | A | +G | T | G | C | 20 |
| 457 | AUS1494 | G | C | A | G | a | g | g | t | g | A | a | g | c | g | a | +A | G | T | G | +C | 20 |
| 458 | AUS1495 | G | c | A | G | A | g | g | t | g | A | a | g | c | g | a | A | +G | +T | +G | +C | 20 |
| 459 | AUS1496 | G | c | A | G | a | g | g | t | g | A | a | g | c | g | a | A | +G | +T | G | C | 20 |
| 460 | AUS1497 | G | c | A | G | A | g | g | t | g | A | a | g | c | g | a | A | +G | +T | G | C | 20 |
| 461 | AUS1498 | G | c | A | G | A | g | g | t | g | A | a | g | c | g | A | A | +G | +T | +G | +C | 20 |
| 462 | AUS1499 | G | c | A | G | a | g | g | t | g | A | a | g | c | g | a | A | G | T | G | C | 20 |
| 463 | AUS1500 | G | C | A | G | A | g | g | t | g | A | a | g | c | g | a | +A | +G | T | +G | C | 20 |
| 464 | AUS1501 | G | C | A | g | a | g | g | t | g | A | a | g | c | g | a | A | G | T | G | C | 20 |
| 465 | AUS1502 | G | C | A | G | a | g | g | t | g | A | a | g | c | g | a | A | +G | T | +G | +C | 20 |

POSITION

FIG. 2V

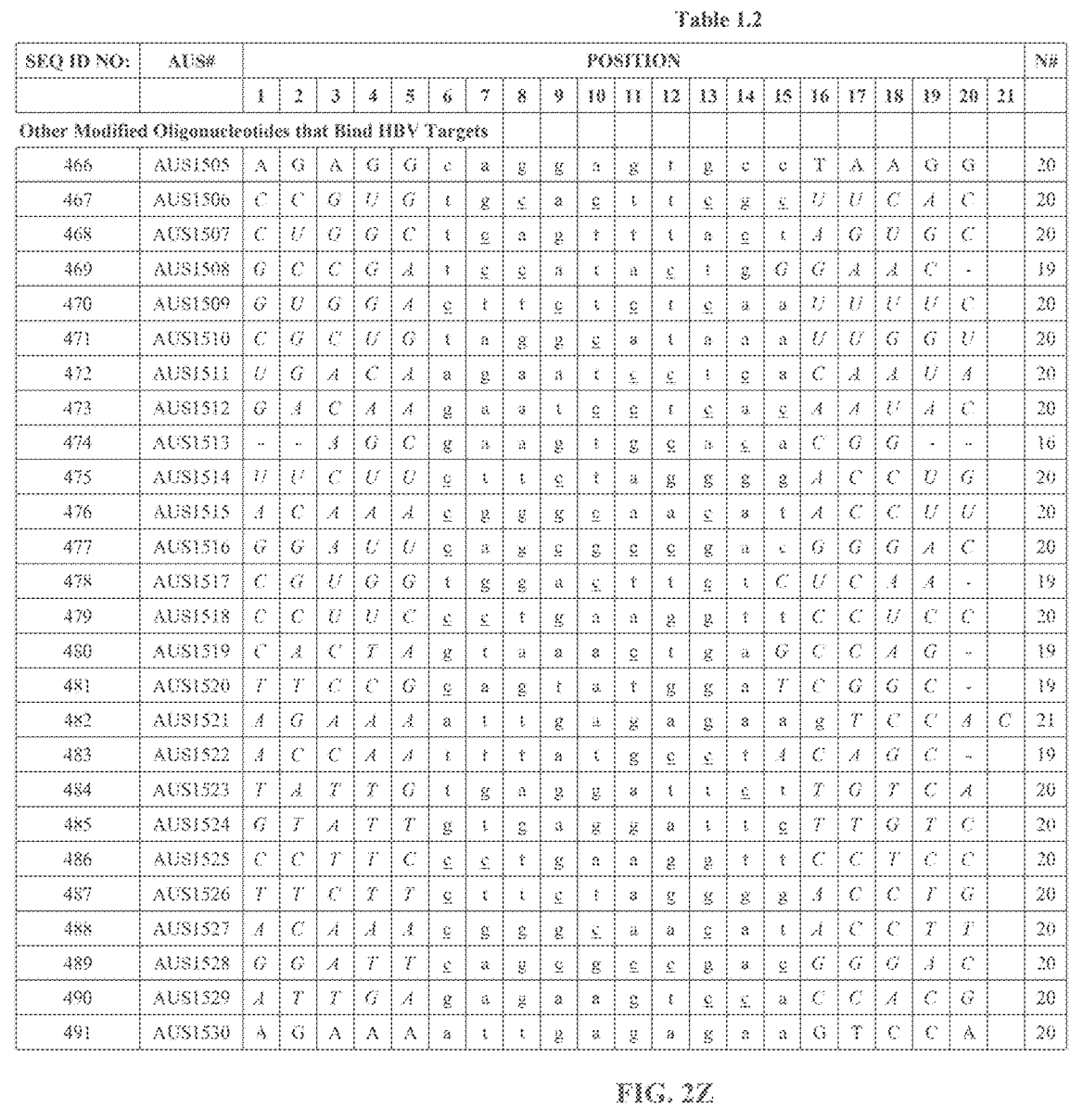

Table 1.2

Other Modified Oligonucleotides that Bind HBV Targets

| SEQ ID NO: | AUS# | N# |
|---|---|---|
| 466 | AUS1505 | 20 |
| 467 | AUS1506 | 20 |
| 468 | AUS1507 | 20 |
| 469 | AUS1508 | 19 |
| 470 | AUS1509 | 20 |
| 471 | AUS1510 | 20 |
| 472 | AUS1511 | 20 |
| 473 | AUS1512 | 20 |
| 474 | AUS1513 | 16 |
| 475 | AUS1514 | 20 |
| 476 | AUS1515 | 20 |
| 477 | AUS1516 | 20 |
| 478 | AUS1517 | 19 |
| 479 | AUS1518 | 20 |
| 480 | AUS1519 | 19 |
| 481 | AUS1520 | 19 |
| 482 | AUS1521 | 21 |
| 483 | AUS1522 | 19 |
| 484 | AUS1523 | 20 |
| 485 | AUS1524 | 20 |
| 486 | AUS1525 | 20 |
| 487 | AUS1526 | 20 |
| 488 | AUS1527 | 20 |
| 489 | AUS1528 | 20 |
| 490 | AUS1529 | 20 |
| 491 | AUS1530 | 20 |

FIG. 2Z

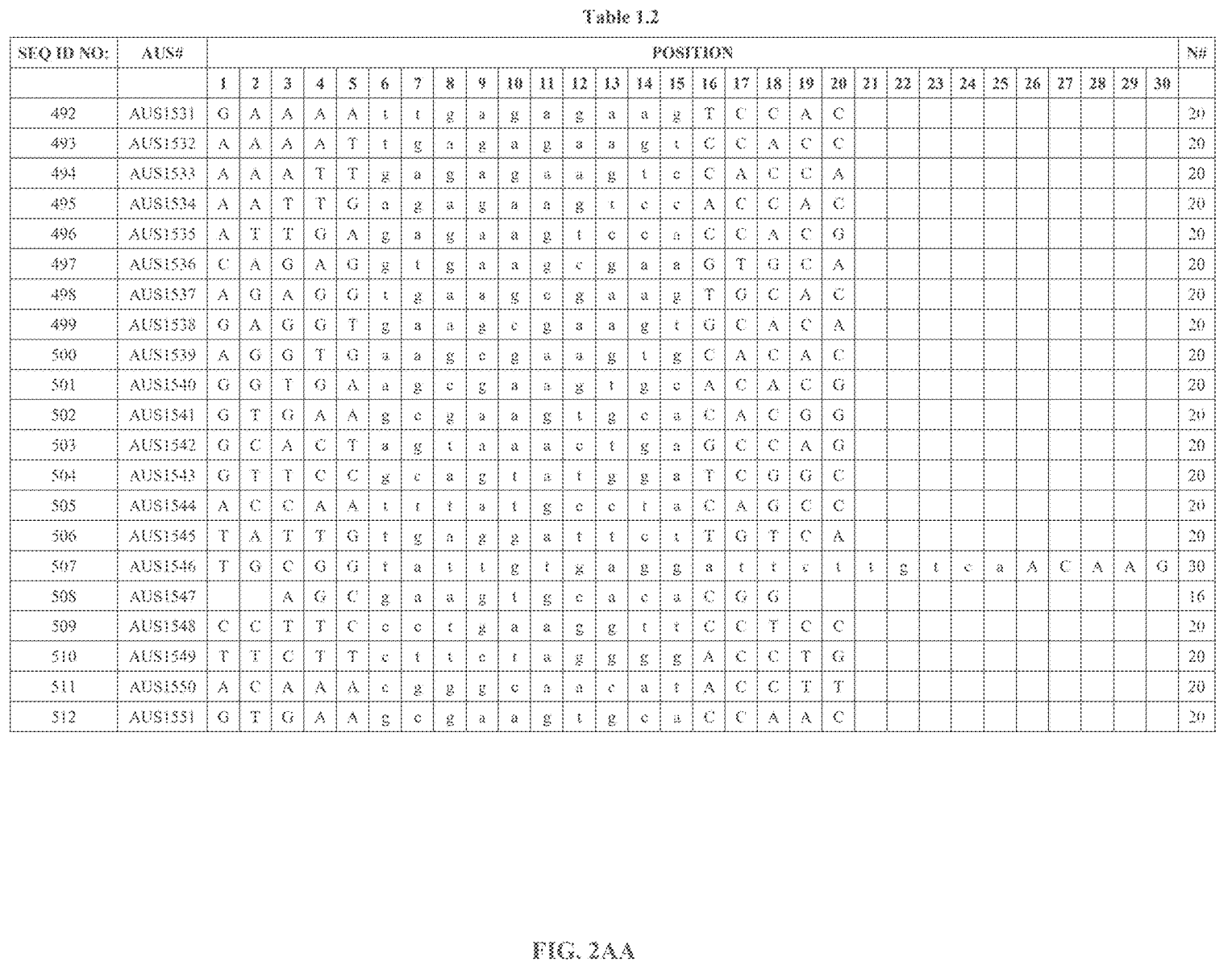

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | N# |
|---|---|---|---|---|---|---|---|---|---|---|---|---|---|---|---|---|---|---|---|---|---|---|---|---|---|---|---|---|---|---|---|---|
| | | | | | | | | | | | | | | | | POSITION | | | | | | | | | | | | | | | | |
| 492 | AUS1531 | G | A | A | A | A | t | t | g | g | g | a | g | a | a | g | T | C | C | A | C | | | | | | | | | | | 20 |
| 493 | AUS1532 | A | A | A | A | T | t | g | g | g | a | g | a | a | g | t | C | C | A | C | C | | | | | | | | | | | 20 |
| 494 | AUS1533 | A | A | A | A | T | g | a | g | g | g | a | g | g | t | c | C | A | C | C | A | | | | | | | | | | | 20 |
| 495 | AUS1534 | A | A | T | T | G | a | g | g | a | a | g | g | t | c | c | A | C | C | A | C | | | | | | | | | | | 20 |
| 496 | AUS1535 | A | T | T | T | A | g | t | g | a | a | a | t | c | c | a | C | C | A | C | G | | | | | | | | | | | 20 |
| 497 | AUS1536 | C | A | G | G | G | t | g | a | a | a | a | c | g | a | g | G | T | G | C | A | | | | | | | | | | | 20 |
| 498 | AUS1537 | A | G | A | A | G | g | a | a | g | g | g | a | a | a | g | T | G | A | A | C | | | | | | | | | | | 20 |
| 499 | AUS1538 | G | A | G | G | T | a | a | g | c | c | a | a | g | g | t | G | C | A | C | A | | | | | | | | | | | 20 |
| 500 | AUS1539 | A | G | G | G | G | a | g | c | a | g | a | t | t | c | g | C | A | C | A | C | | | | | | | | | | | 20 |
| 501 | AUS1540 | G | G | T | T | A | g | g | g | a | a | g | a | g | g | a | A | C | A | C | G | | | | | | | | | | | 20 |
| 502 | AUS1541 | G | T | G | G | A | a | c | g | a | a | a | c | t | g | a | C | A | C | G | G | | | | | | | | | | | 20 |
| 503 | AUS1542 | G | C | A | A | T | g | t | g | a | t | g | t | g | g | a | G | C | C | A | G | | | | | | | | | | | 20 |
| 504 | AUS1543 | G | T | T | C | C | t | t | a | t | c | a | t | c | t | t | T | A | G | C | C | | | | | | | | | | | 20 |
| 505 | AUS1544 | A | C | C | A | A | g | g | a | g | g | a | c | a | c | g | C | C | T | C | A | | | | | | | | | | | 20 |
| 506 | AUS1545 | T | A | T | T | G | c | a | g | g | a | t | t | g | t | t | A | G | T | G | T | | | | | | | | | | | 20 |
| 507 | AUS1546 | T | G | C | G | G | c | g | g | g | c | a | g | g | c | g | C | C | T | C | A | | | | | | | | | | | 20 |
| 508 | AUS1547 | | | A | G | C | t | a | a | g | g | a | c | a | a | g | t | t | t | v | t | t | g | t | c | a | A | C | A | A | G | 16 |
| 509 | AUS1548 | C | C | T | G | T | c | c | c | c | c | a | c | g | c | t | C | C | G | C | C | | | | | | | | | | | 20 |
| 510 | AUS1549 | T | T | C | T | T | c | c | t | t | t | c | g | g | t | c | C | C | T | T | G | | | | | | | | | | | 20 |
| 511 | AUS1550 | A | C | A | A | A | c | g | a | g | c | c | c | c | g | t | A | C | C | T | T | | | | | | | | | | | 20 |
| 512 | AUS1551 | G | T | G | A | A | g | c | g | g | a | g | t | g | c | a | C | C | A | A | C | | | | | | | | | | | 20 |

FIG. 2AA

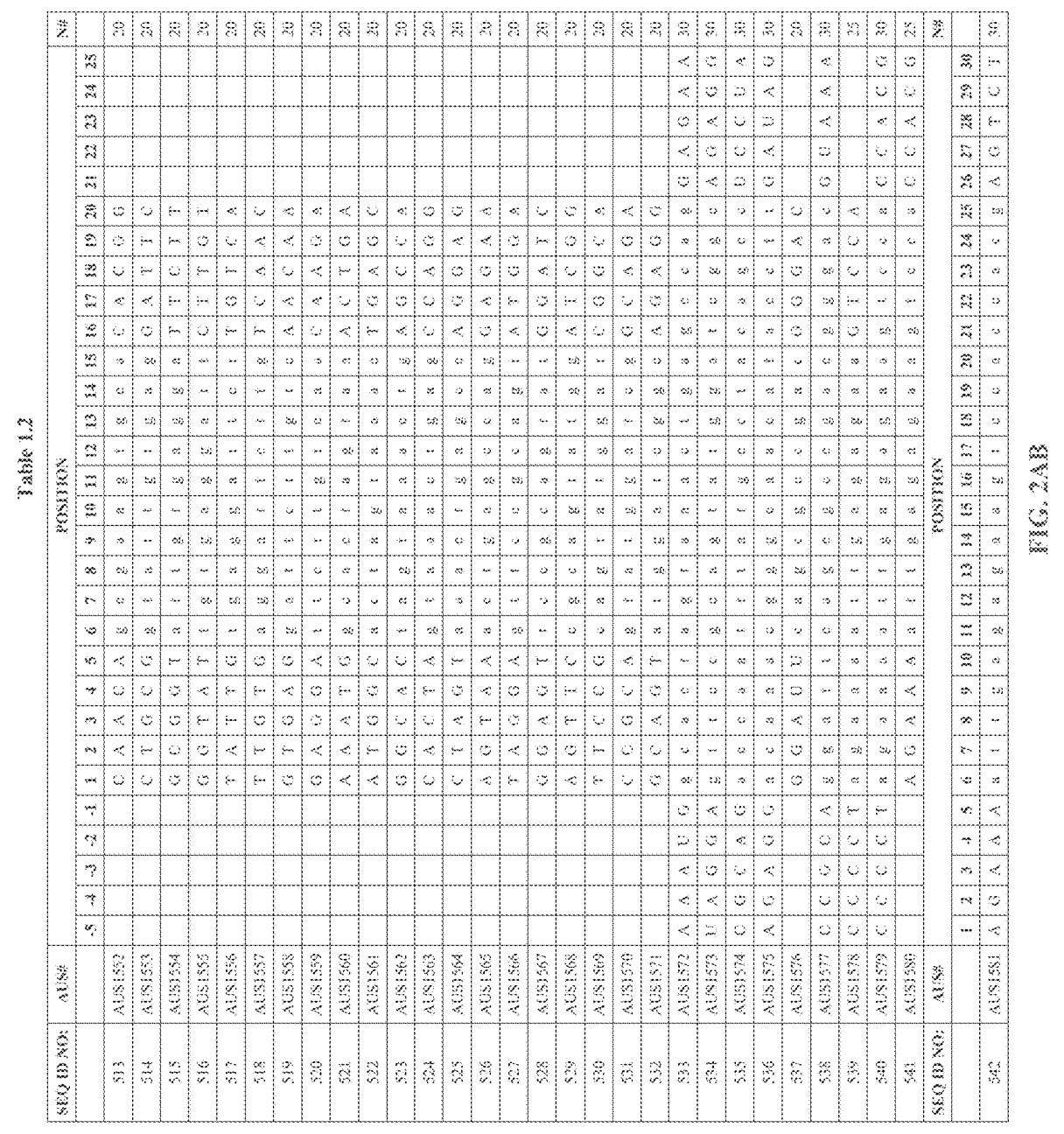

Table 1.2

FIG. 2AB

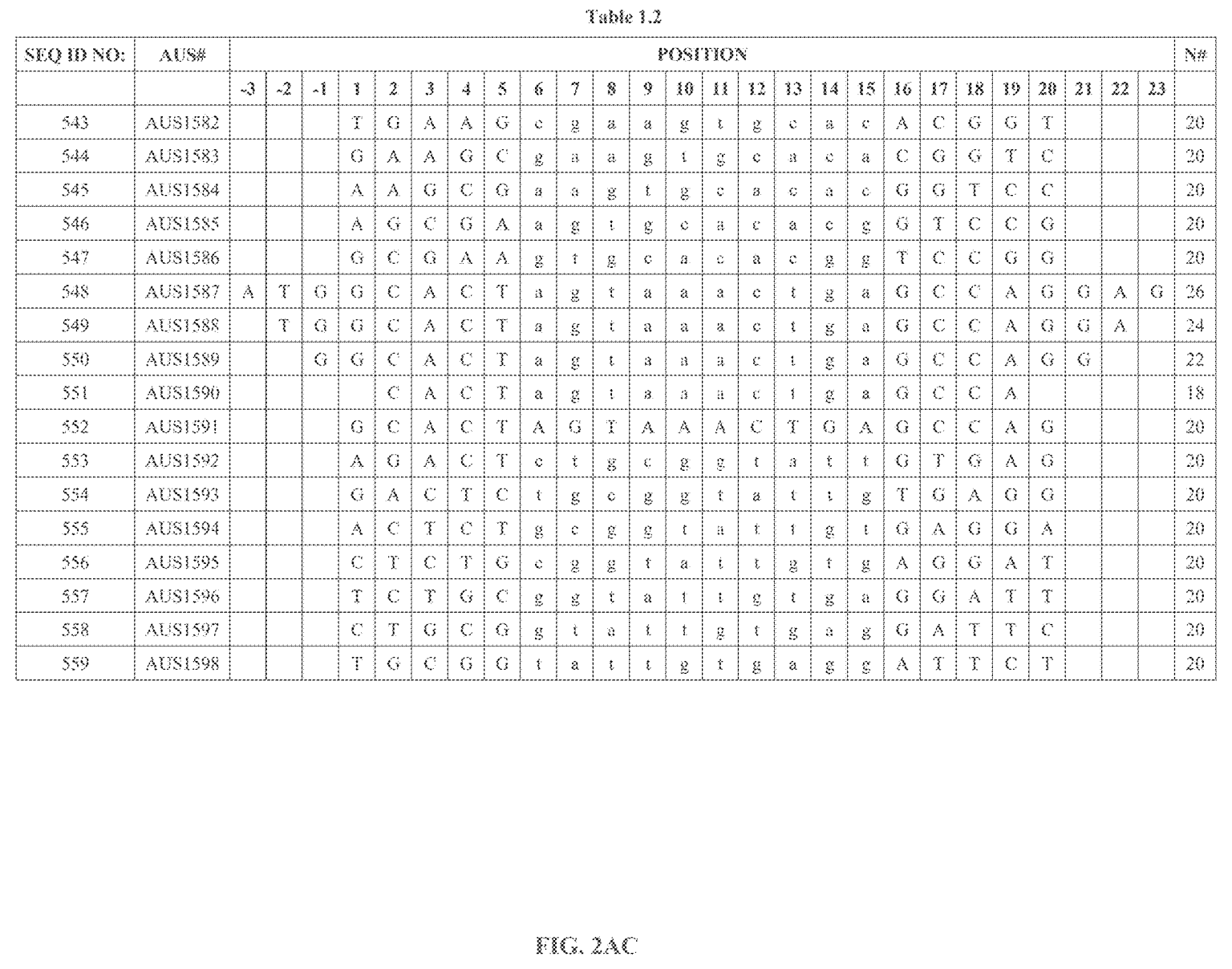

Table 1.2

| SEQ ID NO: | AUS# | -3 | -2 | -1 | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | N# |
|---|---|---|---|---|---|---|---|---|---|---|---|---|---|---|---|---|---|---|---|---|---|---|---|---|---|---|---|---|
| 543 | AUS1582 | | | | T | G | A | A | G | c | g | a | a | g | g | g | c | a | c | A | C | G | G | T | | | | 20 |
| 544 | AUS1583 | | | | G | A | A | G | C | g | t | a | g | t | g | c | g | c | a | C | G | G | T | C | | | | 20 |
| 545 | AUS1584 | | | | A | A | G | C | G | a | a | g | t | g | c | a | c | c | c | G | G | T | C | C | | | | 20 |
| 546 | AUS1585 | | | | A | G | C | G | A | g | a | t | g | c | a | c | a | c | g | G | T | C | C | G | | | | 20 |
| 547 | AUS1586 | | | | G | C | G | A | A | g | t | g | c | a | c | a | g | a | g | T | C | C | G | G | | | | 20 |
| 548 | AUS1587 | A | T | G | G | C | A | A | T | a | g | t | a | g | a | c | t | g | a | G | C | C | A | G | G | A | G | 26 |
| 549 | AUS1588 | | T | G | G | C | A | A | T | a | g | t | a | g | a | c | t | g | a | G | C | C | A | G | G | A | | 24 |
| 550 | AUS1589 | | | G | G | C | A | A | T | a | g | t | g | a | c | c | t | g | a | G | C | C | A | G | G | | | 22 |
| 551 | AUS1590 | | | | G | C | A | A | T | a | a | t | a | a | a | c | t | a | a | G | C | C | A | G | | | | 18 |
| 552 | AUS1591 | | | | G | A | G | C | T | A | G | T | A | A | A | C | T | G | A | G | T | C | A | G | | | | 20 |
| 553 | AUS1592 | | | | A | G | A | C | T | c | g | g | c | g | g | a | a | t | t | G | G | G | A | G | | | | 20 |
| 554 | AUS1593 | | | | G | A | C | T | C | t | c | g | g | g | t | a | a | t | g | A | A | A | A | G | | | | 20 |
| 555 | AUS1594 | | | | A | C | T | T | G | g | g | g | t | t | t | a | g | a | t | G | G | G | A | A | | | | 20 |
| 556 | AUS1595 | | | | C | T | T | T | C | c | a | g | t | a | a | g | t | g | g | A | A | A | T | T | | | | 20 |
| 557 | AUS1596 | | | | T | C | T | T | G | g | g | t | a | t | t | a | t | c | a | G | T | T | T | T | | | | 20 |
| 558 | AUS1597 | | | | C | T | G | C | C | g | g | g | t | t | t | g | c | a | c | G | A | T | C | C | | | | 20 |
| 559 | AUS1598 | | | | T | G | C | G | G | t | a | t | t | g | t | a | g | c | g | A | T | T | T | T | | | | 20 |

POSITION

FIG. 2AC

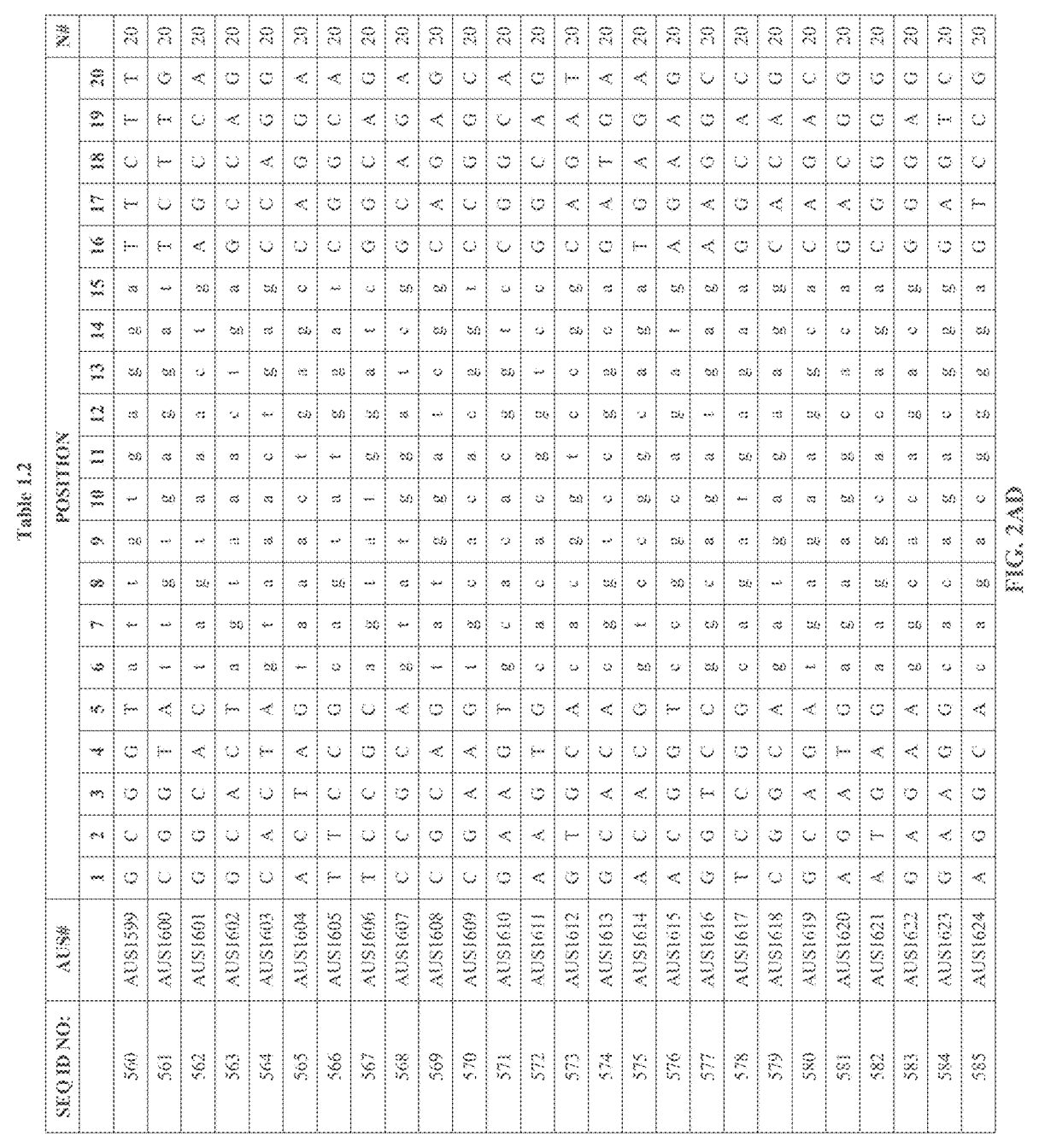

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 560 | AUS1599 | G | C | G | G | T | a | t | t | g | t | g | a | g | g | g | T | T | C | T | T | 20 |
| 561 | AUS1600 | C | G | G | T | A | t | t | g | t | g | a | g | g | a | t | T | C | T | T | G | 20 |
| 562 | AUS1601 | G | G | C | A | C | t | a | g | t | a | g | t | c | g | g | A | G | C | C | A | 20 |
| 563 | AUS1602 | G | C | A | C | T | g | g | t | a | a | c | t | t | g | a | G | C | C | A | G | 20 |
| 564 | AUS1603 | C | A | C | T | A | t | t | a | g | c | t | t | g | g | g | C | C | A | G | C | 20 |
| 565 | AUS1604 | A | C | T | A | G | c | a | g | t | a | t | g | a | a | c | C | A | G | G | A | 20 |
| 566 | AUS1605 | T | T | C | G | C | a | a | t | g | t | g | g | a | t | t | G | G | G | C | A | 20 |
| 567 | AUS1606 | T | C | C | C | C | g | g | c | t | g | g | g | t | c | c | G | C | A | A | G | 20 |
| 568 | AUS1607 | C | C | G | A | A | t | t | a | t | g | a | a | c | g | g | C | A | C | G | A | 20 |
| 569 | AUS1608 | C | G | C | A | G | a | g | c | g | g | g | g | t | g | g | C | C | G | A | G | 20 |
| 570 | AUS1609 | C | G | A | G | T | c | c | c | t | c | c | c | c | t | t | G | G | G | G | C | 20 |
| 571 | AUS1610 | G | A | A | T | G | c | a | a | c | a | g | g | c | c | c | C | A | C | C | A | 20 |
| 572 | AUS1611 | A | A | G | T | A | g | g | c | g | c | g | g | g | g | g | G | A | G | A | G | 20 |
| 573 | AUS1612 | G | T | G | C | A | c | t | c | a | g | a | c | a | t | a | T | G | T | G | T | 20 |
| 574 | AUS1613 | C | C | A | C | G | c | c | g | c | a | a | g | a | a | a | A | A | A | A | A | 20 |
| 575 | AUS1614 | A | C | A | G | G | g | a | c | g | g | a | c | g | a | a | A | G | A | G | A | 20 |
| 576 | AUS1615 | A | G | G | C | T | t | g | g | a | t | g | a | a | a | g | G | A | G | A | G | 20 |
| 577 | AUS1616 | G | G | T | G | C | a | c | c | g | a | a | g | g | g | g | C | A | C | A | C | 20 |
| 578 | AUS1617 | T | C | C | C | G | a | g | a | a | c | a | c | a | a | a | C | A | G | A | C | 20 |
| 579 | AUS1618 | C | G | G | G | A | a | a | g | g | g | g | g | g | g | g | G | A | C | A | G | 20 |
| 580 | AUS1619 | G | C | A | G | T | a | c | c | a | c | a | c | a | c | a | C | A | G | G | C | 20 |
| 581 | AUS1620 | A | G | A | T | G | g | g | g | g | g | g | g | g | g | g | C | G | C | G | G | 20 |
| 582 | AUS1621 | A | T | G | A | A | a | a | c | a | a | a | c | a | c | g | G | G | G | G | G | 20 |
| 583 | AUS1622 | G | A | A | A | G | g | g | c | g | g | g | g | g | g | g | C | A | G | A | C | 20 |
| 584 | AUS1623 | G | A | G | G | A | c | a | c | a | g | a | c | a | c | g | G | G | G | T | C | 20 |
| 585 | AUS1624 | A | G | G | C | A | c | a | g | c | c | g | g | g | g | a | G | T | C | C | G | 20 |

POSITION

FIG. 2AD

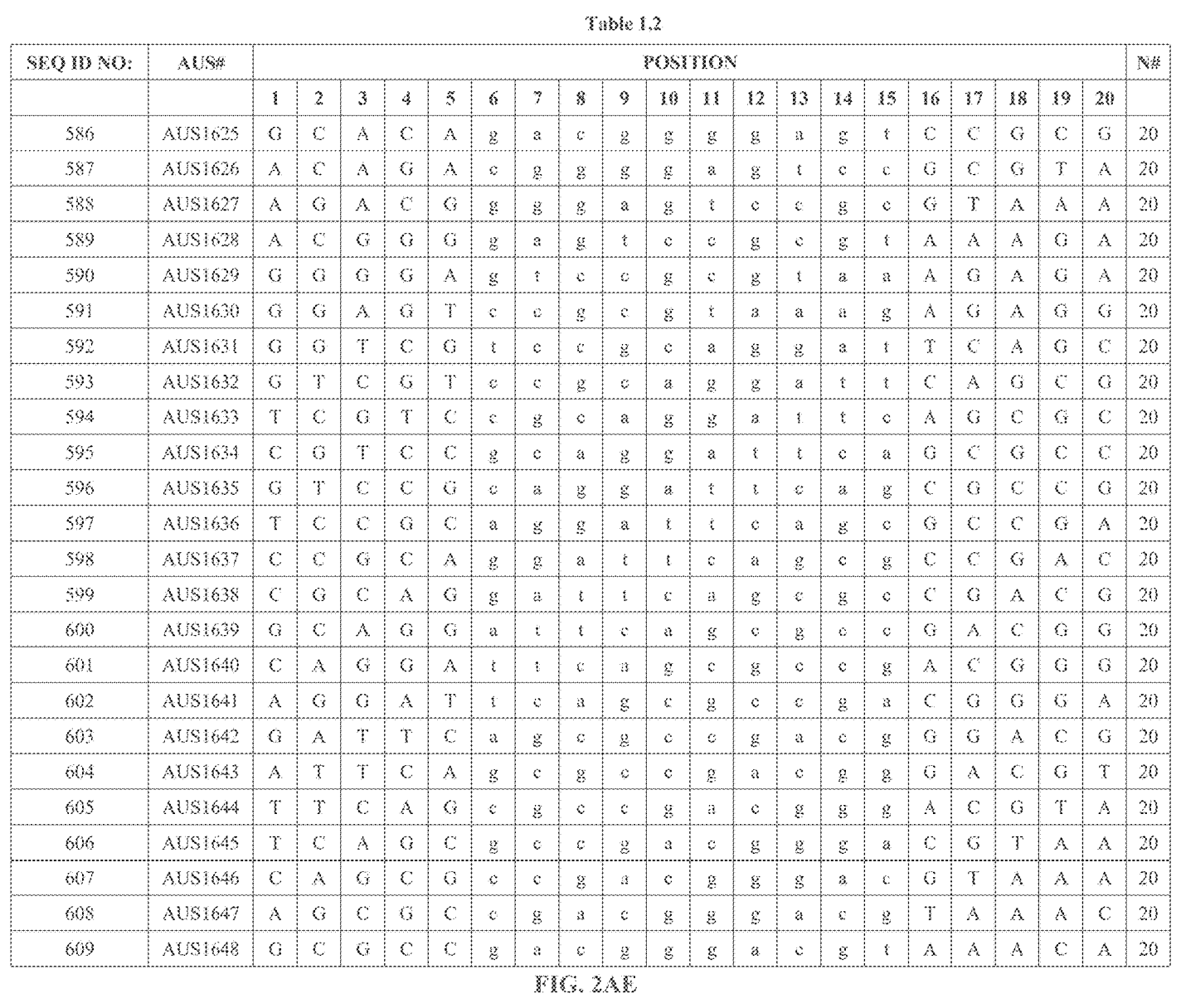

Table 1.2

| SEQ ID NO: | AUS# | POSITION | | | | | | | | | | | | | | | | | | | | N# |
|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | |
| 586 | AUS1625 | G | C | A | C | A | g | a | c | g | g | g | g | a | g | t | C | C | G | C | G | 20 |
| 587 | AUS1626 | A | C | A | G | A | c | g | g | g | g | a | g | t | c | c | G | C | G | T | A | 20 |
| 588 | AUS1627 | A | G | A | C | A | g | g | g | a | g | t | c | c | g | c | G | T | A | A | A | 20 |
| 589 | AUS1628 | A | C | G | G | G | a | a | c | t | c | c | g | c | g | t | A | A | A | G | A | 20 |
| 590 | AUS1629 | G | G | G | G | G | g | t | c | c | g | c | g | t | a | a | A | G | A | G | A | 20 |
| 591 | AUS1630 | G | G | A | G | A | c | c | g | c | g | t | a | a | a | g | A | G | A | G | G | 20 |
| 592 | AUS1631 | G | G | T | C | T | t | c | c | g | c | a | g | g | a | t | T | C | A | G | C | 20 |
| 593 | AUS1632 | G | T | C | G | G | c | c | g | g | c | g | g | a | t | t | C | A | G | C | G | 20 |
| 594 | AUS1633 | T | C | G | T | T | c | c | a | g | a | a | t | t | t | c | A | C | G | C | C | 20 |
| 595 | AUS1634 | C | C | C | C | C | g | g | a | g | t | t | t | c | c | g | G | C | C | C | C | 20 |
| 596 | AUS1635 | G | C | C | G | G | a | b | g | a | a | t | t | c | a | g | C | C | C | C | C | 20 |
| 597 | AUS1636 | T | C | C | C | C | g | g | t | t | t | c | c | g | g | c | C | C | C | A | A | 20 |
| 598 | AUS1637 | C | C | C | A | A | a | a | a | t | t | c | a | g | c | c | G | C | A | C | C | 20 |
| 599 | AUS1638 | C | G | A | G | G | c | t | t | t | c | c | g | c | c | c | A | G | G | G | G | 20 |
| 600 | AUS1639 | G | C | G | G | G | a | c | c | a | c | c | g | g | c | c | C | A | G | G | G | 20 |
| 601 | AUS1640 | C | A | A | A | A | g | g | g | g | g | c | c | c | c | g | A | G | A | G | A | 20 |
| 602 | AUS1641 | A | C | G | T | T | c | c | g | a | c | c | g | g | c | c | C | G | G | G | G | 20 |
| 603 | AUS1642 | G | A | T | C | C | g | c | c | g | c | g | g | c | g | g | G | G | T | G | T | 20 |
| 604 | AUS1643 | A | T | C | A | A | c | c | c | c | c | g | g | c | g | g | A | A | A | A | A | 20 |
| 605 | AUS1644 | T | T | A | T | G | g | g | g | a | g | g | g | a | g | t | C | C | A | A | A | 20 |
| 606 | AUS1645 | T | C | G | C | C | c | c | g | c | c | c | g | g | c | c | G | G | A | A | A | 20 |
| 607 | AUS1646 | C | A | G | C | C | c | c | b | c | c | c | g | a | c | c | G | A | A | A | C | 20 |
| 608 | AUS1647 | A | G | C | G | C | c | g | b | g | g | g | g | a | c | c | T | A | A | A | A | 20 |
| 609 | AUS1648 | G | C | G | C | C | g | b | c | g | g | g | b | c | g | t | A | A | A | C | A | 20 |

FIG. 2AE

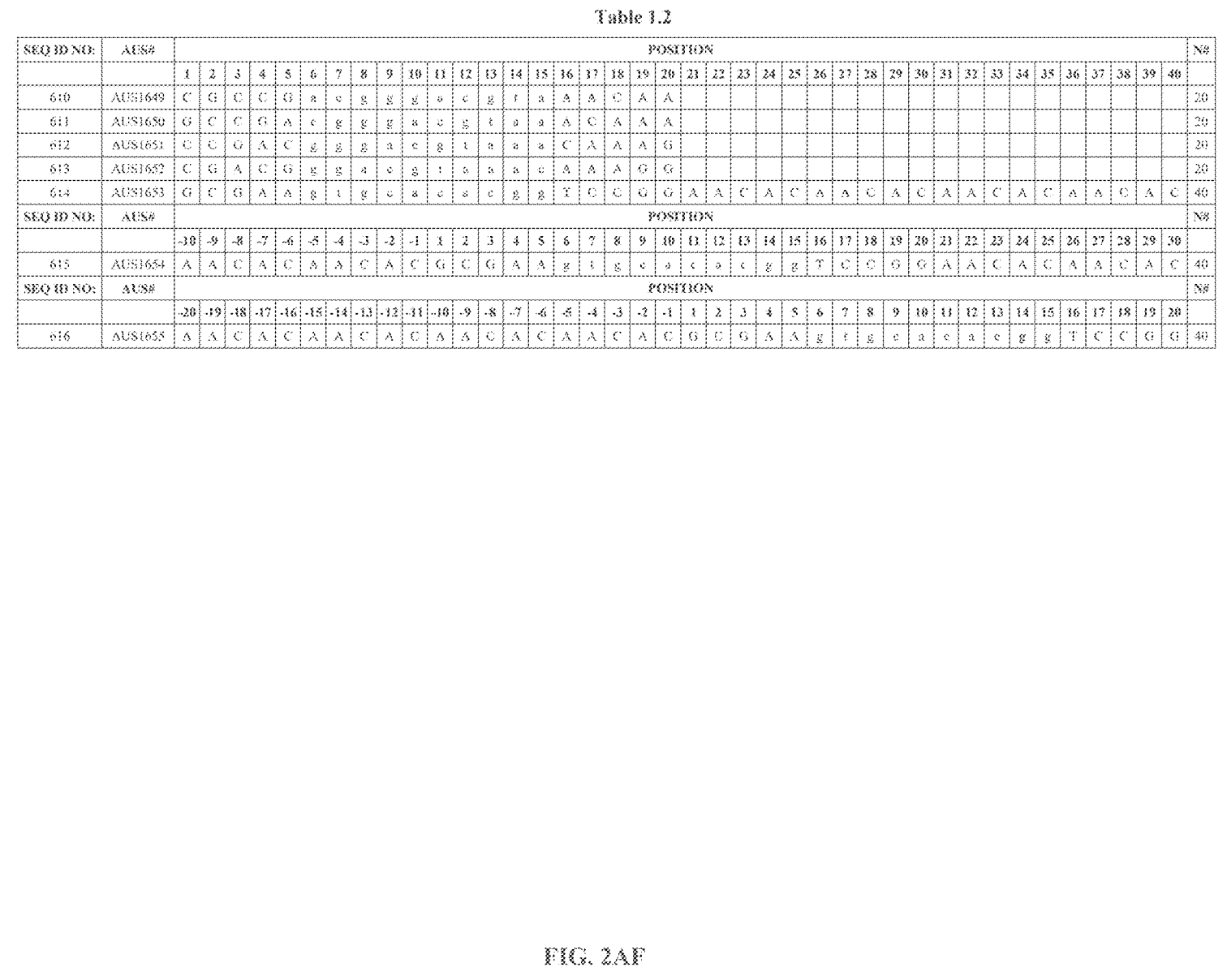

Table 1.2

FIG. 2AF

Table 1.2

| SEQ ID NO: | AUS# | 1 | 2 | 3 | 4 | 5 | 6 | 7 | 8 | 9 | 10 | 11 | 12 | 13 | 14 | 15 | 16 | 17 | 18 | 19 | 20 | N# |
|---|---|---|---|---|---|---|---|---|---|---|---|---|---|---|---|---|---|---|---|---|---|---|
| 621 | AUS1660 | G | C | G | A | A | g | t | g | c | a | c | a | c | g | g | A | C | C | G | G | 20 |
| 622 | AUS1661 | C | G | G | T | C | c | g | g | c | a | gg | a | t | g | g | G | A | A | G | G | 20 |
| 623 | AUS1662 | G | T | C | C | G | g | c | a | g | a | t | g | a | g | g | A | G | G | C | A | 20 |
| 624 | AUS1663 | C | C | C | G | C | a | g | a | t | g | a | g | a | a | g | G | C | A | C | A | 20 |
| 625 | AUS1664 | G | G | C | A | C | a | t | g | a | g | a | a | g | g | c | A | C | A | G | A | 20 |
| 626 | AUS1665 | A | A | G | G | G | a | c | a | g | a | c | g | g | g | g | A | G | T | C | C | 20 |
| 627 | AUS1666 | G | G | C | A | C | a | g | a | c | g | gg | g | g | a | g | T | C | C | G | C | 20 |
| 628 | AUS1667 | C | A | C | A | C | c | c | g | g | t | gg | a | g | t | c | C | G | C | G | C | 20 |
| 629 | AUS1668 | G | A | G | T | G | g | g | c | g | a | a | a | a | g | a | G | A | G | G | T | 20 |
| 630 | AUS1669 | A | G | T | C | C | c | c | g | t | a | a | a | g | a | g | A | G | G | T | T | 20 |
| 631 | AUS1670 | G | T | C | C | G | g | g | t | a | a | a | gg | a | g | g | G | G | G | G | G | 20 |
| 632 | AUS1671 | T | C | C | C | C | c | t | a | a | a | a | a | g | a | a | G | T | T | T | C | 20 |
| 633 | AUS1672 | C | C | G | C | G | gg | a | a | a | g | gg | gg | gg | g | gg | T | G | G | G | G | 20 |
| 634 | AUS1673 | G | C | G | T | A | a | a | gg | a | gg | a | gg | gg | t | gg | C | G | C | C | C | 20 |

FIG. 2AG

Table L2

| SEQ ID NO: | AUS#: | \multicolumn{23}{c}{POSITION} | | | | | | | | | | | | | | | | | | | | | | N# |
|---|---|---|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | |
| 635 | AUS1674 | G | T | A | A | A | g | a | g | a | g | g | t | g | c | g | c | C | C | C | G | | | | 20 |
| 636 | AUS1675 | A | A | A | G | A | g | a | g | g | t | g | c | g | c | u | u | C | G | T | C | | | | 20 |
| 637 | AUS1676 | G | C | G | A | A | g | t | g | c | a | c | a | c | g | g | T | C | C | G | G | | | | 20 |
| 638 | AUS1678 | G | T | C | C | G | c | g | t | a | a | a | g | g | g | a | G | G | T | G | C | | | | 20 |
| 639 | AUS1679 | G | T | G | A | A | g | c | g | a | a | g | t | g | c | a | C | A | C | G | G | | | | 20 |
| 640 | AUS1681 | C | C | T | T | C | c | c | c | g | a | a | g | g | - | t | C | C | T | C | C | | | | 20 |
| 641 | AUS1683 | G | G | T | C | C | g | g | g | a | g | a | - | g | a | g | A | A | G | G | C | | | | 20 |
| 642 | AUS1684 | G | T | C | C | G | c | g | t | a | a | a | g | g | g | a | G | G | T | G | C | | | | 20 |
| 643 | AUS1685 | G | T | G | C | A | g | c | t | g | a | a | t | g | c | a | C | A | C | G | G | | | | 20 |
| 644 | AUS1687 | - | U | G | A | C | U | g | t | g | a | a | c | g | t | t | c | g | a | G | A | U | G | A | 22 |
| 645 | AUS1688 | - | U | G | A | C | U | g | t | g | a | a | c | g | t | t | c | g | a | G | A | U | G | A | 22 |
| 646 | AUS1689 | - | U | G | A | C | U | g | t | g | a | a | c | g | t | t | c | g | a | G | A | U | G | A | 22 |
| 647 | AUS1690 | - | U | G | A | C | U | g | t | g | a | a | c | g | t | t | c | g | a | G | +A | +T | +G | +A | 22 |
| 648 | AUS1691 | - | +T | +G | +A | +C | +T | a | g | t | a | a | c | g | t | t | c | g | a | +G | +A | +T | +G | +A | 22 |
| 649 | AUS1693 | C | C | G | G | C | g | t | a | c | a | a | c | c | a | g | G | C | A | C | A | | | | 20 |
| 650 | AUS1694 | G | C | G | A | A | g | c | g | a | a | c | t | c | g | g | T | C | C | G | C | | | | 20 |
| 651 | AUS1695 | G | T | C | C | G | c | c | t | a | a | a | g | g | c | a | G | G | T | G | C | | | | 20 |
| 652 | AUS1696 | G | T | G | A | A | g | c | g | a | a | a | t | g | c | a | C | A | C | G | G | | | | 20 |
| 653 | AUS1697 | G | T | G | A | A | g | c | g | a | a | g | t | g | c | a | C | A | C | G | G | | | | 20 |
| 654 | AUS1698 | G | T | C | A | A | g | c | g | a | a | a | t | g | c | a | C | A | C | G | G | | | | 20 |
| 655 | AUS1699 | G | T | G | A | A | g | c | g | a | a | C | t | g | c | a | C | A | C | G | G | | | | 20 |
| 656 | AUS1700 | G | T | G | A | A | g | c | g | a | a | G | t | g | c | a | C | A | C | G | G | | | | 20 |

FIG. 2AH

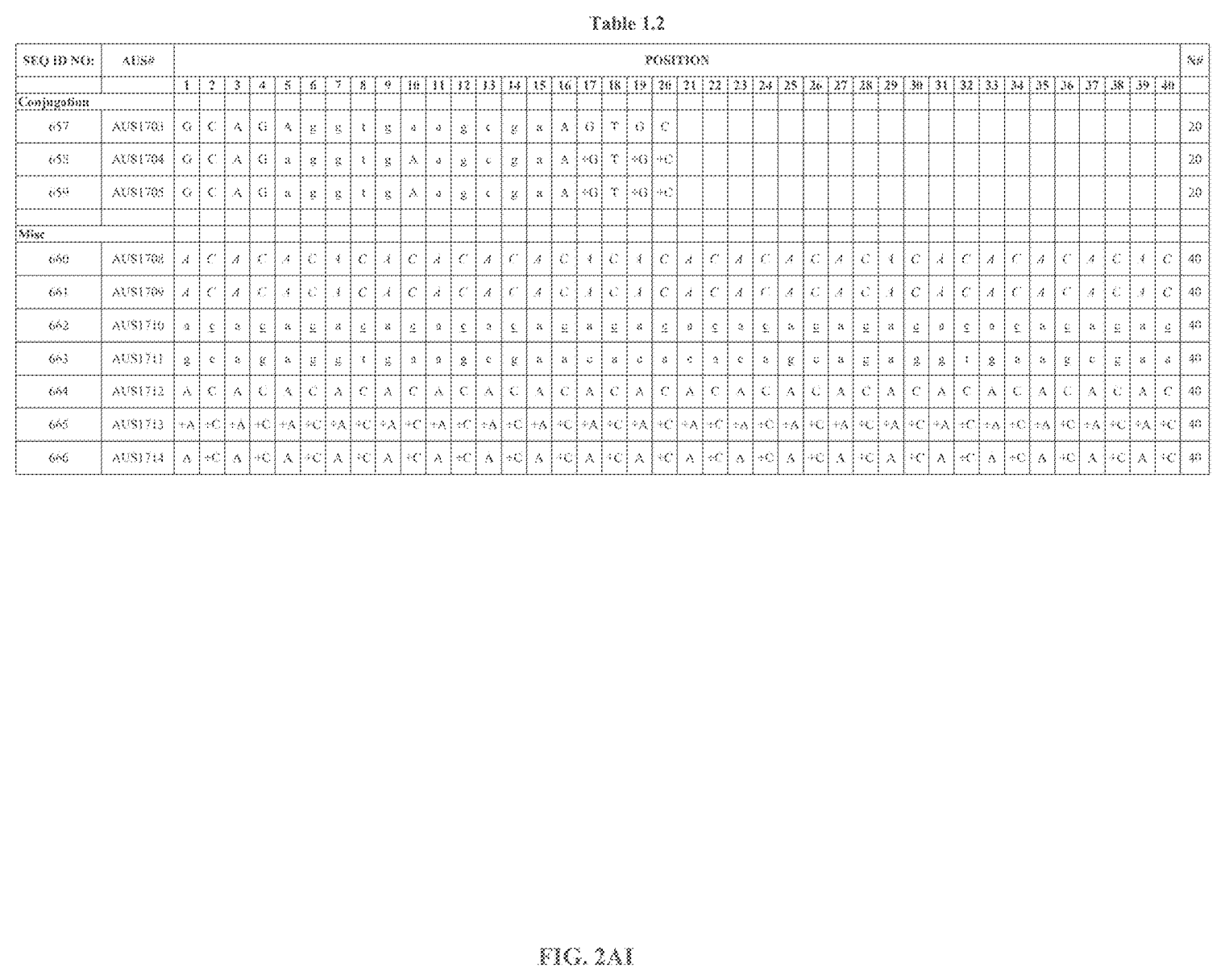

Table 1.2

| SEQ ID NO: | ABS? | POSITION | | | | | | | | | | | | | | | | | | | | | | | | | | | | | | | | | | | | | | N# |
|---|---|---|---|---|---|---|---|---|---|---|---|---|---|---|---|---|---|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | |
| Conjugation | | | | | | | | | | | | | | | | | | | | | | | | | | | | | | | | | | | | | | | | | | |
| 657 | AUS1702 | | | | | | | | | | | | | | | | | | | | | | | | | | | | | | | | | | | | | | | | | | 20 |
| 658 | AUS1704 | | | | | | | | | | | | | | | | | | | | | | | | | | | | | | | | | | | | | | | | | | 20 |
| 659 | AUS1708 | | | | | | | | | | | | | | | | | | | | | | | | | | | | | | | | | | | | | | | | | | 20 |
| Misc | | | | | | | | | | | | | | | | | | | | | | | | | | | | | | | | | | | | | | | | | | |
| 660 | AUS1702 | | | | | | | | | | | | | | | | | | | | | | | | | | | | | | | | | | | | | | | | | | 40 |
| 661 | AUS1708 | | | | | | | | | | | | | | | | | | | | | | | | | | | | | | | | | | | | | | | | | | 40 |
| 662 | AUS1710 | | | | | | | | | | | | | | | | | | | | | | | | | | | | | | | | | | | | | | | | | | 40 |
| 663 | AUS1711 | | | | | | | | | | | | | | | | | | | | | | | | | | | | | | | | | | | | | | | | | | 40 |
| 664 | AUS1712 | | | | | | | | | | | | | | | | | | | | | | | | | | | | | | | | | | | | | | | | | | 40 |
| 665 | AUS1713 | | | | | | | | | | | | | | | | | | | | | | | | | | | | | | | | | | | | | | | | | | 40 |
| 666 | AUS1714 | | | | | | | | | | | | | | | | | | | | | | | | | | | | | | | | | | | | | | | | | | 40 |

FIG. 2AI

Table 15.1

| SEQ ID NO. | ID | Days post dosing (40mg/kg, n=5) | | | | | | | | | | | | | |
|---|---|---|---|---|---|---|---|---|---|---|---|---|---|---|---|
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -1.58 | 0.35 | -1.05 | 0.14 | -1.08 | 0.16 | -1.07 | 0.14 | -0.46 | 0.12 | -0.77 | 0.08 |
| 641 | AUS1683 | 0 | | -0.39 | 0.13 | -0.68 | 0.29 | -0.53 | 0.15 | -0.66 | 0.44 | -0.16 | 0.11 | -0.46 | 0.17 |
| 642 | AUS1684 | 0 | | -0.29 | 0.06 | -2.17 | 0.33 | -2.44 | 0.21 | -2.12 | 1.06 | -2.26 | 0.27 | -2.29 | 0.28 |
| 643 | AUS1685 | 0 | | -0.99 | 0.3 | -1.33 | 0.74 | -0.9 | 0.92 | -0.85 | 1.03 | -0.26 | 0.08 | -0.36 | 0.21 |
| 203 | AUS1220 | 0 | | 0 | 0.36 | -0.43 | 0.14 | -0.43 | 0.14 | -0.57 | 0.39 | -0.25 | 0.3 | -0.72 | 0.49 |
| 294 | AUS1322 | 0 | | -2.19 | 0.51 | -2.61 | 0.33 | -2.57 | 0.3 | -2.41 | 0.31 | -1.36 | 0.38 | -1.13 | 0.29 |
| 295 | AUS1323 | 0 | | -1.76 | 0.36 | -2.22 | 0.28 | -2.05 | 0.38 | -1.59 | 0.26 | -1.39 | 0.44 | -1.03 | 0.2 |
| 296 | AUS1324 | 0 | | -2.35 | 1.04 | -2 | 0.59 | -1.93 | 0.52 | -1.73 | 1.04 | -1 | 0.51 | -0.93 | 0.3 |

FIG. 14

Table 15.2

| SEQ ID NO: | ID | Days post dosing (40mg/kg, n=4) | | | | | | | | | | | | | |
| --- | --- | --- | --- | --- | --- | --- | --- | --- | --- | --- | --- | --- | --- | --- | --- |
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -1.13 | 0.64 | -0.83 | 0.73 | -1.15 | 0.71 | -0.92 | 0.50 | -0.35 | 0.41 | -0.10 | 0.20 |
| 155 | AUS1169 | 0 | | -1.83 | 0.26 | -1.75 | 1.06 | -2.18 | 0.40 | -1.90 | 0.43 | -0.82 | 0.26 | -0.32 | 0.30 |
| 157 | AUS1171 | 0 | | -1.34 | 0.48 | -1.25 | 0.35 | -1.54 | 0.36 | -1.40 | 0.37 | -0.53 | 0.43 | -0.72 | 0.53 |
| 156 | AUS1170 | 0 | | -1.53 | 0.20 | -1.36 | 0.79 | -2.11 | 0.26 | -1.62 | 0.34 | -0.86 | 0.23 | -0.50 | 0.22 |
| 154 | AUS1168 | 0 | | -1.50 | 0.27 | -1.62 | 0.21 | -1.87 | 0.27 | -1.55 | 0.08 | -0.60 | 0.26 | -0.35 | 0.14 |
| 294 | AUS1322 | 0 | | -2.33 | 0.14 | -2.32 | 0.16 | -2.11 | 0.11 | -1.98 | 0.19 | -1.69 | 0.29 | -0.98 | 0.17 |

FIG. 15

Table 15.3

| SEQ ID NO. | ID | Days post dosing (30mg/kg, n=2-3) | | | | | | | | | | | |
| | | 0 | | 3 | | 7 | | 10 | | 14 | | 21 | |
| | | mean | SD | mean | SD | mean | SD | mean | SD | mean | SD | mean | SD |
| 10 | AUS1233 | 0 | | -0.43 | 0.17 | -0.58 | 0.15 | -0.33 | 0.15 | -0.61 | 0.15 | 0.08 | 0.14 |
| 397 | AUS1434 | 0 | | -1.60 | 0.23 | -2.17 | 0.39 | -3.07 | 0.23 | -2.31 | 0.33 | -1.06 | 0.25 |
| 398 | AUS1435 | 0 | | -1.51 | 0.54 | -2.28 | 0.52 | -2.50 | 0.92 | -2.01 | 0.53 | -1.17 | 1.07 |
| 403 | AUS1440 | 0 | | -1.69 | 0.05 | -2.34 | 0.08 | -2.73 | 0.29 | -1.74 | 0.31 | -0.42 | 0.16 |
| 399 | AUS1436 | 0 | | -1.56 | 0.29 | -2.59 | 0.25 | -2.84 | 0.26 | -1.89 | 0.14 | -0.44 | 0.31 |
| 400 | AUS1437 | 0 | | -1.36 | 0.51 | -2.57 | 0.18 | -1.66 | 0.95 | -1.44 | 0.29 | -0.03 | 0.24 |
| 401 | AUS1438 | 0 | | -1.39 | 0.11 | -2.45 | 0.41 | -1.55 | 0.81 | -2.03 | 0.27 | -0.83 | 0.21 |
| 402 | AUS1439 | 0 | | -1.89 | 0.19 | -2.89 | 0.19 | -2.09 | 1.11 | -1.90 | 0.33 | -0.58 | 0.09 |
| 404 | AUS1441 | 0 | | -1.59 | 0.13 | -2.36 | 0.35 | -1.84 | 0.38 | -1.34 | 0.36 | 0.14 | 0.09 |
| 385 | AUS1422 | 0 | | -1.36 | 0.51 | -2.06 | 0.72 | -1.55 | 0.87 | -1.54 | 0.78 | 0.01 | 1.10 |
| 386 | AUS1423 | 0 | | -1.44 | 0.69 | -2.01 | 1.21 | -1.56 | 1.42 | -1.12 | 1.26 | 0.08 | 1.05 |
| 387 | AUS1424 | 0 | | -1.35 | 0.47 | -2.21 | 0.67 | -1.85 | 0.76 | -1.63 | 0.54 | -0.45 | 0.40 |
| 388 | AUS1425 | 0 | | -1.34 | 0.29 | -2.27 | 0.55 | -2.05 | 0.55 | -1.72 | 0.34 | -0.63 | 0.06 |
| 389 | AUS1426 | 0 | | -0.69 | 0.65 | -1.35 | 0.83 | -0.64 | 0.66 | -1.03 | 0.55 | 0.32 | 0.06 |
| 390 | AUS1427 | 0 | | -1.27 | 0.12 | -2.51 | 0.37 | -1.99 | 0.05 | -2.39 | 0.04 | -0.92 | 0.53 |
| 391 | AUS1428 | 0 | | -1.50 | 0.41 | -2.12 | 0.21 | -1.69 | 0.39 | -1.91 | 0.09 | -0.18 | 0.52 |
| 392 | AUS1429 | 0 | | -1.43 | 0.18 | -2.03 | 0.14 | -1.89 | 0.30 | -1.30 | 0.72 | 0.38 | 0.05 |
| 393 | AUS1430 | 0 | | -1.48 | 0.13 | -1.78 | 0.26 | -1.62 | 0.29 | -1.44 | 0.14 | 0.02 | 0.07 |
| 394 | AUS1431 | 0 | | -1.46 | 0.13 | -1.94 | 0.13 | -1.14 | 0.61 | -1.78 | 0.10 | -0.24 | 0.38 |
| 395 | AUS1432 | 0 | | -1.11 | 0.22 | -1.43 | 0.06 | -1.45 | 0.29 | -1.90 | 0.10 | 0.03 | 0.03 |
| 396 | AUS1433 | 0 | | -1.28 | 0.03 | -1.39 | 0.11 | -0.62 | 0.10 | -1.39 | 0.38 | 0.52 | 0.19 |

FIG. 16

Table 15.4

| SEQ ID NO: | ID | Days post dosing (30mg/kg, n=2-3) | | | | | | | | | | | |
|---|---|---|---|---|---|---|---|---|---|---|---|---|---|
| | | 0 | | 3 | | 7 | | 10 | | 14 | | 21 | |
| | | mean | SD | mean | SD | mean | SD | mean | SD | mean | SD | mean | SD |
| 10 | AUS1 233 | 0 | | -0.41 | 0.31 | -0.02 | 0.26 | 0.06 | 0.32 | -0.08 | 0.23 | 0.10 | 0.41 |
| 426 | AUS1 463 | 0 | | -1.24 | 0.49 | -1.46 | 0.49 | -1.49 | 0.97 | -0.73 | 0.39 | -0.72 | 0.06 |
| 429 | AUS1 466 | 0 | | -1.65 | 0.54 | -1.90 | 0.40 | -1.86 | 0.29 | -0.97 | 0.42 | -0.87 | 0.31 |
| 439 | AUS1 476 | 0 | | -1.49 | 0.64 | -1.15 | 0.70 | -0.86 | 0.66 | -0.62 | 0.29 | -0.55 | 0.35 |
| 435 | AUS1 472 | 0 | | -0.48 | 0.50 | -1.17 | 0.12 | -0.77 | 0.79 | -0.29 | 0.39 | -0.11 | 0.38 |
| 452 | AUS1 489 | 0 | | -1.11 | 0.40 | -0.74 | 0.13 | -0.61 | 0.44 | -0.14 | 0.14 | -0.22 | 0.28 |
| 422 | AUS1 459 | 0 | | -1.60 | 0.02 | -1.53 | 0.27 | -2.16 | 0.50 | -1.06 | 0.02 | -0.66 | 0.12 |

FIG. 17

Table 15.5

Days post dosing (30mg/kg, n=4)

| SEQ ID NO. | ID | 0 | | 3 | | 7 | | 10 | | 14 | | 21 | | 28 | |
|---|---|---|---|---|---|---|---|---|---|---|---|---|---|---|---|
| | | mean | SD | mean | SD | mean | SD | mean | SD | mean | SD | mean | SD | mean | SD |
| 10 | AUS1233 | 0 | | -0.30 | 0.24 | -0.44 | 0.14 | -0.49 | 0.17 | -0.36 | 0.23 | -0.37 | 0.12 | -0.27 | 0.10 |
| 455 | AUS1492 | 0 | | -1.63 | 0.38 | -1.45 | 0.28 | -1.66 | 0.52 | -1.36 | 0.39 | -0.82 | 0.24 | -0.39 | 0.20 |
| 458 | AUS1495 | 0 | | -1.10 | 0.22 | -1.17 | 0.29 | -1.43 | 0.12 | -1.17 | 0.13 | -0.57 | 0.16 | -0.37 | 0.16 |
| 457 | AUS1494 | 0 | | -0.94 | 0.35 | -1.07 | 0.36 | -1.22 | 0.39 | -0.94 | 0.16 | -0.50 | 0.19 | -0.35 | 0.26 |
| 456 | AUS1493 | 0 | | -1.13 | 0.13 | -1.20 | 0.26 | -1.47 | 0.26 | -1.22 | 0.18 | -0.62 | 0.16 | -0.41 | 0.10 |
| 445 | AUS1482 | 0 | | -0.42 | 0.19 | -0.24 | 0.09 | -0.38 | 0.16 | -0.12 | 0.16 | 0.05 | 0.25 | 0.17 | 0.18 |
| 404 | AUS1441 | 0 | | -1.48 | 0.27 | -1.21 | 0.24 | -1.32 | 0.32 | -1.13 | 0.22 | -0.30 | 0.06 | -0.06 | 0.13 |

FIG. 18

Table 15.6

| SEQ ID NO: | ID | Days post dosing (48mg/kg, n=1,2) | | | | | | | | | | | |
| --- | --- | --- | --- | --- | --- | --- | --- | --- | --- | --- | --- | --- | --- |
| | | 0 | | 3 | | 7 | | 10 | | 14 | | 21 | |
| | | mean | SD | mean | SD | mean | SD | mean | SD | mean | SD | mean | SD |
| 10 | AUS1233 | 0 | | -0.42 | 0.03 | -0.62 | 0.02 | -0.67 | 0.09 | -0.64 | 0.19 | -0.59 | 0.19 |
| 649 | AUS1693 | 0 | | -0.25 | | -0.28 | | -0.35 | | -0.38 | | -0.31 | |
| 650 | AUS1694 | 0 | | -0.21 | 0.05 | -0.35 | 0.02 | -0.46 | 0.03 | -0.45 | 0.01 | -0.35 | 0.01 |
| 651 | AUS1695 | 0 | | -0.14 | | -0.59 | | -0.76 | | -0.83 | | -0.84 | |
| 652 | AUS1696 | 0 | | -0.27 | | -0.24 | | -0.27 | | -0.23 | | -0.27 | |
| 653 | AUS1697 | 0 | | -0.21 | 0.04 | -0.12 | 0.02 | -0.16 | 0.00 | -0.17 | 0.00 | -0.20 | 0.08 |
| 654 | AUS1698 | 0 | | -0.27 | 0.09 | -0.45 | 0.11 | -0.61 | 0.11 | -0.53 | 0.33 | -0.37 | 0.14 |
| 655 | AUS1699 | 0 | | -0.14 | 0.16 | -0.45 | 0.19 | -0.62 | 0.14 | -0.57 | 0.18 | -0.57 | 0.24 |
| 656 | AUS1700 | 0 | | -0.12 | 0.12 | -0.23 | 0.17 | -0.34 | 0.22 | -0.39 | 0.18 | -0.41 | 0.24 |

FIG. 19

Table 15.7

| SEQ ID NO: | ID | Days post dosing (10mg/kg for first two rows, 30mg/kg for Rows 3 and 4) | | | | | | | | | | | | |
| --- | --- | --- | --- | --- | --- | --- | --- | --- | --- | --- | --- | --- | --- | --- |
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1 233 | 0 | | -0.36 | 0.19 | -0.50 | 0.23 | -0.42 | 0.23 | -0.38 | 0.25 | -0.20 | 0.23 | -0.38 | 0.20 |
| 456 | AUS1 493 | 0 | | -0.56 | 0.11 | -0.92 | 0.15 | -0.58 | 0.29 | -0.48 | 0.20 | -0.28 | 0.13 | -0.16 | 0.15 |
| 10 | AUS1 233 | 0 | | -1.34 | 0.34 | -1.02 | 0.16 | -0.60 | 0.30 | -0.60 | 0.25 | -0.56 | 0.18 | -0.36 | 0.11 |
| 456 | AUS1 493 | 0 | | -2.62 | 0.27 | -2.94 | 0.39 | -2.48 | 0.41 | -2.58 | 0.69 | -1.42 | 0.52 | -1.04 | 0.40 |

FIG. 20

Table 16.1

| SEQ ID NO: | ID | Days post dosing (60mg/kg, n=3-5) | | | | | | | | | | | | | |
|---|---|---|---|---|---|---|---|---|---|---|---|---|---|---|---|
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -0.82 | 0.32 | -1.45 | 0.19 | -1.37 | 0.63 | -1.48 | 0.39 | -0.95 | 0.30 | -0.97 | 0.70 |
| 641 | AUS1683 | 0 | | -0.25 | 0.08 | -0.49 | 0.17 | -0.50 | 0.21 | -0.54 | 0.19 | -0.37 | 0.08 | -0.37 | 0.08 |
| 642 | AUS1684 | 0 | | -0.47 | 0.27 | -1.16 | 0.31 | -1.36 | 0.21 | -1.62 | 0.05 | -1.33 | 0.16 | -1.41 | 0.23 |
| 643 | AUS1685 | 0 | | -0.37 | 0.16 | -0.80 | 0.31 | -0.73 | 0.26 | -0.72 | 0.21 | -0.36 | 0.16 | -0.40 | 0.11 |
| 203 | AUS1222 | 0 | | -0.38 | 0.21 | -0.68 | 0.32 | -0.56 | 0.21 | -0.59 | 0.13 | -0.53 | 0.18 | -0.82 | 0.56 |
| 294 | AUS1322 | 0 | | -1.22 | 0.42 | -2.27 | 0.38 | -2.54 | 0.41 | -2.92 | 0.33 | -3.09 | 0.26 | -2.74 | 0.24 |
| 295 | AUS1323 | 0 | | -0.98 | 0.23 | -1.79 | 0.43 | -1.83 | 0.43 | -2.38 | 0.36 | -2.85 | 0.65 | -2.87 | 0.88 |
| 296 | AUS1324 | 0 | | -1.03 | 0.45 | -1.54 | 0.07 | -1.66 | 0.12 | -2.01 | 0.15 | -1.88 | 0.39 | -1.73 | 0.43 |

FIG. 21

Table 16.2

| SEQ ID NO: | ID | Days post dosing (60mg/kg, n=4) | | | | | | | | | | | | | |
| --- | --- | --- | --- | --- | --- | --- | --- | --- | --- | --- | --- | --- | --- | --- | --- |
| | | 0 | | 3 | | 7 | | 10 | | 14 | | 21 | | 28 | |
| | | mean | SD | mean | SD | mean | SD | mean | SD | mean | SD | mean | SD | mean | SD |
| 155 | AUS11 69 | 0 | | -0.63 | 0.03 | -1.89 | 0.13 | -2.17 | 0.32 | -2.26 | 0.27 | -2.02 | 0.08 | -1.72 | 0.10 |
| 157 | AUS11 71 | 0 | | -0.22 | 0.07 | -0.64 | 0.24 | -0.61 | 0.17 | -0.63 | 0.14 | -0.77 | 0.09 | -0.73 | 0.10 |
| 156 | AUS11 70 | 0 | | -0.54 | 0.01 | -1.67 | 0.12 | -2.00 | 0.51 | -2.17 | 0.48 | -2.25 | 0.19 | -1.80 | 0.27 |
| 154 | AUS11 68 | 0 | | -0.43 | 0.12 | -1.21 | 0.27 | -1.34 | 0.23 | -1.39 | 0.18 | -1.42 | 0.33 | -2.12 | 1.61 |

FIG. 22

Table 16.3

| SEQ ID NO: | ID | Days post dosing (60mg/kg, n=3-5) | | | | | | | | | | | |
| | | 0 | | 3 | | 7 | | 10 | | 14 | | 21 | |
| | | mean | SD | mean | SD | mean | SD | mean | SD | mean | SD | mean | SD |
| 10 | AUS1 233 | 0 | | -0.55 | 0.11 | -1.37 | 0.20 | -1.46 | 0.16 | -1.73 | 0.17 | -1.30 | 0.21 |
| 158 | AUS1 173 | 0 | | -0.74 | 0.13 | -2.13 | 0.22 | -2.27 | 0.39 | -2.84 | 0.48 | -2.22 | 0.37 |
| 159 | AUS1 174 | 0 | | -0.96 | 0.35 | -2.68 | 0.90 | -2.52 | 0.53 | -3.17 | 0.66 | -2.68 | 0.93 |
| 160 | AUS1 175 | 0 | | -0.99 | 0.60 | -2.07 | 0.58 | -1.96 | 0.34 | -2.07 | 0.35 | -1.24 | 0.22 |
| 161 | AUS1 176 | 0 | | -0.49 | 0.07 | -1.39 | 0.36 | -1.29 | 0.40 | -1.17 | 0.44 | -0.53 | 0.32 |

FIG. 23

Table 16.4

| SEQ ID NO. | ID | Days post dosing (60mg/kg, n=3-5) | | | | | | | | | |
| | | 0 | | 3 | | 7 | | 10 | | 14 | |
| | | mean | SD | mean | SD | mean | SD | mean | SD | mean | SD |
| 10 | AUS1233 | 0 | | -0.77 | 0.26 | -1.22 | 0.53 | -1.23 | 0.51 | -1.58 | 0.59 |
| 158 | AUS1173 | 0 | | -0.83 | 0.41 | -1.68 | 0.45 | -1.75 | 0.54 | -2.34 | 0.83 |
| 162 | AUS1177 | 0 | | -0.36 | 0.13 | -0.93 | 0.19 | -1.07 | 0.22 | -1.49 | 0.26 |
| 163 | AUS1178 | 0 | | -0.79 | 0.29 | -1.56 | 0.13 | -1.57 | 0.27 | -2.08 | 0.11 |
| 164 | AUS1179 | 0 | | -0.66 | 0.55 | -0.89 | 0.50 | -0.97 | 0.55 | -1.43 | 0.98 |
| 165 | AUS1180 | 0 | | -0.27 | 0.13 | -0.42 | 0.11 | -0.35 | 0.20 | -0.71 | 0.14 |
| 166 | AUS1181 | 0 | | -0.45 | 0.29 | -0.87 | 0.46 | -0.79 | 0.32 | -1.03 | 0.53 |
| 167 | AUS1182 | 0 | | -0.65 | 0.34 | -0.94 | 0.35 | -0.95 | 0.43 | -1.17 | 0.43 |
| 179 | AUS1194 | 0 | | -0.59 | 0.26 | -0.78 | 0.41 | -0.91 | 0.54 | -1.35 | 0.41 |
| 169 | AUS1184 | 0 | | -0.55 | 0.19 | -0.99 | 0.14 | -0.96 | 0.16 | -1.31 | 0.12 |
| 170 | AUS1185 | 0 | | -0.54 | 0.54 | -1.06 | 0.35 | -1.35 | 0.28 | -1.61 | 0.39 |
| 171 | AUS1186 | 0 | | -0.74 | 0.15 | -1.19 | 0.22 | -1.40 | 0.24 | -1.83 | 0.22 |
| 172 | AUS1187 | 0 | | -0.35 | 0.16 | -0.65 | 0.22 | -0.91 | 0.31 | -1.36 | 0.36 |
| 173 | AUS1188 | 0 | | -0.91 | 0.34 | -1.56 | 0.06 | -1.80 | 0.05 | -2.17 | 0.14 |
| 174 | AUS1189 | 0 | | -0.41 | 0.34 | -0.55 | 0.39 | -0.44 | 0.37 | -0.73 | 0.30 |
| 175 | AUS1190 | 0 | | -1.27 | 0.27 | -1.78 | 0.36 | -1.97 | 0.74 | -2.20 | 0.25 |
| 176 | AUS1191 | 0 | | -0.91 | 0.77 | -1.38 | 1.19 | -1.70 | 1.36 | -1.48 | 0.84 |
| 177 | AUS1192 | 0 | | -0.96 | 0.41 | -2.29 | 1.37 | -1.39 | 0.26 | -2.40 | 0.93 |
| 178 | AUS1193 | 0 | | -1.01 | 0.95 | -1.59 | 1.11 | -1.49 | 0.83 | -1.89 | 0.45 |
| 168 | AUS1183 | 0 | | -0.96 | 0.57 | -1.99 | 1.36 | -1.79 | 1.11 | -1.93 | 1.08 |
| 212 | AUS1239 | 0 | | -0.65 | 0.26 | -1.50 | 0.86 | -1.74 | 1.21 | -1.42 | 0.43 |
| 297 | AUS1325 | 0 | | -1.25 | 0.58 | -2.48 | 0.72 | -3.57 | 0.83 | -2.61 | 0.27 |
| 298 | AUS1326 | 0 | | -1.17 | 0.52 | -2.52 | 0.59 | -3.28 | 0.57 | -2.47 | 0.47 |
| 299 | AUS1327 | 0 | | -1.01 | 0.37 | -2.80 | 0.34 | -4.10 | 0.93 | -3.39 | 0.46 |
| 300 | AUS1328 | 0 | | -0.88 | 0.22 | -2.63 | 0.60 | -3.28 | 0.46 | -3.02 | 0.80 |
| 301 | AUS1329 | 0 | | -1.08 | 0.55 | -2.41 | 0.42 | -2.65 | 0.81 | -2.95 | 0.55 |
| 160 | AUS1175 | 0 | | -1.16 | 0.24 | -2.15 | 0.29 | -1.94 | 0.22 | -2.35 | 0.25 |
| 330 | AUS1361 | 0 | | -1.02 | 0.24 | -2.64 | 0.45 | -2.48 | 0.24 | -2.83 | 0.37 |
| 331 | AUS1362 | 0 | | -1.50 | 1.08 | -2.48 | 0.88 | -2.53 | 0.57 | -2.34 | 0.25 |

FIG. 24

Table 16.5

| SEQ ID NO: | ID | Days post dosing (60mg/kg, n=5) | | | | | | | | | | | |
|---|---|---|---|---|---|---|---|---|---|---|---|---|---|
| | | 0 | | 3 | | 7 | | 10 | | 14 | | 22 | |
| | | mean | SD | mean | SD | mean | SD | mean | SD | mean | SD | mean | SD |
| 10 | AUS1233 | 0 | | -0.50 | 0.18 | -1.04 | 0.11 | -1.45 | 0.24 | -0.97 | 0.15 | -0.85 | 0.22 |
| 294 | AUS1322 | | | -1.03 | 0.37 | -1.71 | 0.26 | -2.51 | 0.41 | -2.12 | 0.29 | -2.58 | 0.38 |
| 346 | AUS1382 | | | -1.10 | 0.40 | -2.12 | 0.41 | -2.94 | 0.65 | -3.66 | 0.52 | -4.45 | 0.48 |
| 347 | AUS1383 | | | -1.79 | 0.74 | -2.61 | 0.54 | -2.65 | 1.38 | -3.79 | 0.60 | -3.90 | 0.39 |
| 348 | AUS1384 | | | -1.34 | 0.86 | -1.65 | 0.30 | -2.46 | 0.49 | -2.45 | 0.43 | -2.76 | 0.45 |
| 349 | AUS1385 | | | -2.25 | 0.76 | -2.06 | 0.29 | -3.20 | 0.39 | -3.23 | 0.37 | -4.23 | 0.51 |

FIG. 25

Table 16.6

| SEQ ID NO: | ID | Days post dosing (60mg/kg, n=5) | | | | | | | | | | | |
| --- | --- | --- | --- | --- | --- | --- | --- | --- | --- | --- | --- | --- | --- |
| | | 0 | | 3 | | 7 | | 10 | | 14 | | 21 | |
| | | mean | SD | mean | SD | mean | SD | mean | SD | mean | SD | mean | SD |
| 294 | AUS1322 | | | -0.67 | 0.18 | -2.06 | 0.25 | -2.45 | 1.09 | -2.99 | 0.82 | -3.01 | 0.40 |
| 351 | AUS1388 | | | -0.91 | 0.37 | -1.77 | 0.38 | -1.62 | 0.82 | -2.20 | 0.80 | -2.43 | 0.73 |
| 352 | AUS1389 | | | -0.94 | 0.67 | -1.33 | 0.58 | -1.60 | 0.93 | -1.43 | 0.59 | -1.84 | 0.66 |
| 353 | AUS1390 | | | -1.13 | 0.76 | -2.00 | 0.37 | -1.68 | 1.19 | -2.12 | 0.50 | -2.85 | 0.72 |
| 355 | AUS1392 | | | -0.77 | 0.31 | -1.33 | 0.13 | -1.29 | 0.89 | -1.43 | 0.22 | -1.97 | 0.25 |
| 356 | AUS1393 | | | -0.73 | 0.47 | -1.28 | 0.18 | -1.83 | 0.40 | -1.40 | 0.34 | -1.83 | 0.38 |
| 359 | AUS1396 | | | -0.78 | 0.02 | -1.85 | 0.10 | -2.18 | 0.92 | -2.45 | 0.34 | -3.72 | 0.27 |
| 366 | AUS1403 | | | -0.84 | 0.43 | -2.16 | 0.32 | -3.04 | 0.44 | -2.83 | 0.66 | -3.20 | 0.38 |
| 372 | AUS1409 | | | -1.09 | 0.52 | -1.97 | 0.29 | -2.68 | 0.35 | -3.51 | 0.39 | -4.33 | 0.38 |
| 374 | AUS1411 | | | -1.19 | 0.66 | -1.97 | 0.48 | -2.31 | 0.73 | -3.04 | 0.68 | -4.45 | 0.30 |
| 376 | AUS1413 | | | -0.84 | 0.33 | -1.60 | 0.50 | -3.13 | 0.71 | -3.06 | 0.89 | -4.21 | 0.69 |
| 377 | AUS1414 | | | -0.92 | 0.71 | -1.59 | 0.33 | -2.32 | 0.52 | -2.76 | 0.37 | -4.28 | 0.63 |
| 378 | AUS1415 | | | -0.96 | 0.21 | -2.45 | 0.38 | -3.39 | 0.22 | -3.24 | 0.47 | -4.18 | 0.34 |

FIG. 26

Table 16.7

| SEQ ID NO: | ID | Days post dosing (60mg/kg, n=4) | | | | | | | | | |
|---|---|---|---|---|---|---|---|---|---|---|---|
| | | 0 | | 3 | | 7 | | 10 | | 14 | |
| | | mean | SD | mean | SD | mean | SD | mean | SD | mean | SD |
| 350 | AUS1387 | | | -1.02 | 0.37 | -1.90 | 0.54 | -2.38 | 0.63 | -2.66 | 0.78 |
| 298 | AUS1326 | | | -0.96 | 0.31 | -1.86 | 0.29 | -2.56 | 0.48 | -2.94 | 0.50 |
| 300 | AUS1328 | | | -0.86 | 0.16 | -2.28 | 0.40 | -3.33 | 0.37 | -4.02 | 0.45 |
| 351 | AUS1388 | | | -0.83 | 0.18 | -1.37 | 0.41 | -1.65 | 0.44 | -1.92 | 0.57 |
| 353 | AUS1390 | | | -1.05 | 0.19 | -1.74 | 0.32 | -2.10 | 0.35 | -2.43 | 0.66 |
| 366 | AUS1403 | | | -1.05 | 0.05 | -1.70 | 0.55 | -2.22 | 0.75 | -2.69 | 0.87 |
| 329 | AUS1360 | | | -0.74 | 0.26 | -1.65 | 0.19 | -1.81 | 0.16 | -1.70 | 0.26 |

FIG. 27

Table 16.8

| SEQ ID NO. | ID | Days post dosing (40mg/kg, n=2-4) | | | | | | | | | | | |
| | | 0 | | 3 | | 7 | | 10 | | 14 | | 21 | |
| | | mean | SD | mean | SD | mean | SD | mean | SD | mean | SD | mean | SD |
| 10 | AUS1433 | 0 | | -0.45 | 0.10 | -0.66 | 0.20 | -1.00 | 0.25 | -1.03 | 0.23 | -0.83 | 0.19 |
| 397 | AUS1434 | 0 | | -1.08 | 0.09 | -1.82 | 0.32 | -2.19 | 0.41 | -2.49 | 0.39 | -2.60 | 0.47 |
| 398 | AUS1435 | 0 | | -1.34 | 0.36 | -1.69 | 0.10 | -2.20 | 0.17 | -2.44 | 0.05 | -2.68 | 0.15 |
| 403 | AUS1440 | 0 | | -1.02 | 0.28 | -1.65 | 0.29 | -2.08 | 0.42 | -2.26 | 0.32 | -2.28 | 0.32 |
| 399 | AUS1436 | 0 | | -1.08 | 0.15 | -1.73 | 0.09 | -1.95 | 0.13 | -2.29 | 0.25 | -1.79 | 0.41 |
| 400 | AUS1437 | 0 | | -1.33 | 0.71 | -2.07 | 0.82 | -2.19 | 0.59 | -2.25 | 0.47 | -1.77 | 0.31 |
| 401 | AUS1438 | 0 | | -1.07 | 0.14 | -1.55 | 0.23 | -2.02 | 0.33 | -2.30 | 0.39 | -2.53 | 0.49 |
| 402 | AUS1439 | 0 | | -1.06 | 0.12 | -1.93 | 0.30 | -2.42 | 0.32 | -2.59 | 0.26 | -2.75 | 0.26 |
| 404 | AUS1441 | 0 | | -0.81 | 0.13 | -1.58 | 0.29 | -1.79 | 0.24 | -1.71 | 0.21 | -1.34 | 0.23 |
| 385 | AUS1422 | 0 | | -1.13 | 0.29 | -2.35 | 1.04 | -2.53 | 0.91 | -2.35 | 0.40 | -2.00 | 0.58 |
| 386 | AUS1423 | 0 | | -1.77 | 0.75 | -2.53 | 0.90 | -2.82 | 0.72 | -2.70 | 0.67 | -2.31 | 0.61 |
| 387 | AUS1424 | 0 | | -1.72 | 1.60 | -2.37 | 0.90 | -2.09 | 0.21 | -2.46 | 0.52 | -2.10 | 1.15 |
| 388 | AUS1425 | 0 | | -1.09 | 0.29 | -2.05 | 0.33 | -2.17 | 0.33 | -2.57 | 0.42 | -2.07 | 0.55 |
| 389 | AUS1426 | 0 | | -0.91 | 0.20 | -1.57 | 0.22 | -1.86 | 0.20 | -2.03 | 0.22 | -1.46 | 0.18 |
| 390 | AUS1427 | 0 | | -0.87 | 0.36 | -1.90 | 0.09 | -2.16 | 0.15 | -2.20 | 0.15 | -1.73 | 0.15 |
| 391 | AUS1428 | 0 | | -0.83 | 0.12 | -2.02 | 0.63 | -2.46 | 0.64 | -2.64 | 1.06 | -2.44 | 1.62 |
| 392 | AUS1429 | 0 | | -0.70 | 0.26 | -1.49 | 0.51 | -1.71 | 0.49 | -1.51 | 0.51 | -0.89 | 0.46 |
| 393 | AUS1430 | 0 | | -1.20 | 0.49 | -2.06 | 0.52 | -2.36 | 0.48 | -2.36 | 0.55 | -1.77 | 0.51 |
| 394 | AUS1431 | 0 | | -0.61 | 0.18 | -1.58 | 0.25 | -1.72 | 0.17 | -1.44 | 0.39 | -0.65 | 0.22 |
| 395 | AUS1432 | 0 | | -0.33 | 0.07 | -1.48 | 0.04 | -3.68 | 0.09 | -1.73 | 0.07 | -1.27 | 0.29 |
| 396 | AUS1433 | 0 | | -1.11 | 0.63 | -1.66 | 0.38 | -1.92 | 0.41 | -1.96 | 0.35 | -1.18 | 0.27 |

FIG. 28

Table 16.9

| SEQ ID NO: | ID | Days post dosing (40mg/kg, n=2-3) | | | | | | | | | | | |
|---|---|---|---|---|---|---|---|---|---|---|---|---|---|
| | | 0 | | 3 | | 7 | | 10 | | 14 | | 21 | |
| | | mean | SD | mean | SD | mean | SD | mean | SD | mean | SD | mean | SD |
| 10 | AUS1233 | 0 | | -0.39 | 0.06 | -0.60 | 0.27 | -0.57 | 0.29 | -0.39 | 0.31 | -0.28 | 0.32 |
| 407 | AUS1444 | 0 | | -0.92 | 0.12 | -2.07 | 0.49 | -2.46 | 0.34 | -2.5 | 0.96 | -1.75 | 1.08 |
| 421 | AUS1458 | 0 | | -0.39 | 0.36 | -1.92 | 0.34 | -2.03 | 0.13 | -1.99 | 0.23 | -1.55 | 0.36 |
| 422 | AUS1459 | 0 | | -0.66 | 0.10 | -1.75 | 0.28 | -1.86 | 0.38 | -1.88 | 0.35 | -1.38 | 0.43 |
| 423 | AUS1460 | 0 | | -1.12 | 0.52 | -1.86 | 0.04 | -1.97 | 0.16 | -1.82 | 0.06 | -1.49 | 0.20 |
| 424 | AUS1461 | 0 | | -0.01 | 0.68 | -1.76 | 0.47 | -1.37 | 0.25 | -1.84 | 0.06 | -1.27 | 0.12 |
| 425 | AUS1462 | 0 | | -0.48 | 0.29 | -1.06 | 0.08 | -1.14 | 0.07 | -0.96 | 0.12 | -0.70 | 0.07 |
| 426 | AUS1463 | 0 | | -1.09 | 0.05 | -1.55 | 0.01 | -1.58 | 0.13 | -1.81 | 0.35 | -3.08 | 2.31 |
| 427 | AUS1464 | 0 | | -0.40 | 0.06 | -0.90 | 0.28 | -1.09 | 0.13 | -0.89 | 0.09 | -0.69 | 0.10 |
| 428 | AUS1465 | 0 | | -0.59 | 0.06 | -0.96 | 0.21 | -1.06 | 0.26 | -0.71 | 0.28 | -0.30 | 0.31 |
| 429 | AUS1466 | 0 | | -0.69 | 0.16 | -1.58 | 0.05 | -1.98 | 0.66 | -1.77 | 0.58 | -1.65 | 1.22 |
| 430 | AUS1467 | 0 | | -0.43 | 0.02 | -1.11 | 0.41 | -1.41 | 0.72 | -1.20 | 0.65 | -1.17 | 0.63 |
| 431 | AUS1468 | 0 | | -0.73 | 0.45 | -1.27 | 0.71 | -1.59 | 0.99 | -0.95 | 0.86 | -0.41 | 1.09 |
| 432 | AUS1469 | 0 | | -0.98 | 0.31 | -1.72 | 0.19 | -1.35 | 0.91 | -1.33 | 0.08 | -1.66 | 0.40 |
| 433 | AUS1470 | 0 | | -0.50 | 0.37 | -0.85 | 0.75 | -1.01 | 0.78 | -0.73 | 0.91 | -0.33 | 1.00 |
| 434 | AUS1471 | 0 | | -0.79 | 0.41 | -1.33 | 1.76 | -2.91 | 2.91 | -2.50 | 2.57 | -3.65 | 0.74 |
| 435 | AUS1472 | 0 | | -0.85 | 0.40 | -1.39 | 0.34 | -1.53 | 0.38 | -1.23 | 3.25 | -0.90 | 0.24 |
| 436 | AUS1473 | 0 | | -0.53 | 0.11 | -0.88 | 0.35 | -1.01 | 0.16 | -0.73 | 0.10 | -0.54 | 0.35 |
| 437 | AUS1474 | 0 | | -0.3 | 0.06 | -0.43 | 0.12 | -0.58 | 0.4 | -0.41 | 0.15 | -0.38 | 0.39 |
| 438 | AUS1475 | 0 | | -0.41 | 0.03 | -0.64 | 0.40 | -0.69 | 0.67 | -0.45 | 0.74 | -0.17 | 0.75 |
| 439 | AUS1476 | 0 | | -0.79 | 0.66 | -1.25 | 0.68 | -1.39 | 0.77 | -0.95 | 1.09 | -0.44 | 1.12 |
| 440 | AUS1477 | 0 | | -0.73 | 0.55 | -0.34 | 0.55 | -0.88 | 0.43 | -0.65 | 0.27 | -0.30 | 0.11 |
| 441 | AUS1478 | 0 | | -0.16 | 0.02 | -0.69 | 0.04 | -0.83 | 0.02 | -0.66 | 0.08 | -0.53 | 0.02 |
| 442 | AUS1479 | 0 | | -0.42 | 0.28 | -0.87 | 0.25 | -1.07 | 0.24 | -0.89 | 0.21 | -0.55 | 0.7 |
| 443 | AUS1480 | 0 | | -0.62 | 0.06 | -1.10 | 0.05 | -1.1 | 0.05 | -1.03 | 0.14 | -0.84 | 0.16 |
| 444 | AUS1481 | 0 | | -0.50 | 0.20 | -0.64 | 0.06 | -0.72 | 0.03 | -0.57 | 0.05 | -0.65 | 0.17 |
| 445 | AUS1482 | 0 | | -0.66 | 0.36 | -1.19 | 0.91 | -1.41 | 1.07 | -1.01 | 0.72 | -0.91 | 0.43 |
| 446 | AUS1483 | 0 | | -0.44 | 0.29 | -0.26 | 0.05 | -0.31 | 0.07 | -0.24 | 0.12 | -0.13 | 0.00 |
| 451 | AUS1488 | 0 | | -0.49 | 0.24 | -0.75 | 0.26 | -0.88 | 0.18 | -0.75 | 0.45 | -0.57 | 0.77 |
| 452 | AUS1489 | 0 | | -0.75 | 0.17 | -1.36 | 0.31 | -1.50 | 0.24 | -1.12 | 0.34 | -0.91 | 0.29 |
| 453 | AUS1490 | 0 | | -0.74 | 0.06 | -1.41 | 0.17 | -1.64 | 0.31 | -1.55 | 0.08 | -1.36 | 0.01 |
| 456 | AUS1443 | 0 | | -0.98 | 0.42 | -1.99 | 0.43 | -2.01 | 0.44 | -2.11 | 0.37 | -2.18 | 0.22 |
| 457 | AUS1444 | 0 | | -1.21 | 0.54 | -2.94 | 1.56 | -3.33 | 1.22 | -3.39 | 1.47 | -2.84 | 1.02 |
| 458 | AUS1445 | 0 | | -1.26 | 0.41 | -1.73 | 0.41 | -1.98 | 0.00 | -1.36 | 0.41 | -0.44 | 0.50 |

FIG. 29

Table 16.10

| SEQ ID NO: | ID | Days post dosing (15mg/kg (top set) or 45mg/kg (bottom set), n=5) | | | | | | | | | | | | | |
|---|---|---|---|---|---|---|---|---|---|---|---|---|---|---|---|
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -0.24 | 0.09 | -0.34 | 0.16 | -0.48 | 0.15 | -0.34 | 0.31 | -0.16 | 0.11 | -0.21 | 0.12 |
| 455 | AUS1492 | 0 | | -0.44 | 0.13 | -0.79 | 0.33 | -0.92 | 0.26 | -0.74 | 0.20 | -0.33 | 0.11 | -0.31 | 0.13 |
| 456 | AUS1493 | 0 | | -0.46 | 0.12 | -0.75 | 0.13 | -0.69 | 0.11 | -0.62 | 0.13 | -0.31 | 0.18 | -0.32 | 0.28 |
| 10 | AUS1233 | 0 | | -0.69 | 0.27 | -1.37 | 0.30 | -1.40 | 0.29 | -1.95 | 1.13 | -1.67 | 1.31 | -1.60 | 1.47 |
| 455 | AUS1492 | 0 | | -0.95 | 0.42 | -1.91 | 0.25 | -2.04 | 0.28 | -1.83 | 0.21 | -1.22 | 0.17 | -0.91 | 0.18 |
| 456 | AUS1493 | 0 | | -0.75 | 0.14 | -1.76 | 0.20 | -1.86 | 0.19 | -1.73 | 0.23 | -1.11 | 0.12 | -0.88 | 0.19 |

FIG. 30

Table 16.11

| SEQ ID NO: | ID | Days post dosing (15 mg/kg top three rows, 45 mg/kg in bottom three rows, n=5) | | | | | | | | | | | | |
|---|---|---|---|---|---|---|---|---|---|---|---|---|---|---|
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -0.30 | 0.08 | -0.30 | 0.14 | -0.23 | 0.08 | -0.11 | 0.08 | -0.04 | 0.06 | -0.1 | 0.09 |
| 455 | AUS1492 | 0 | | -0.57 | 0.17 | -0.68 | 0.16 | -0.71 | 0.17 | -0.50 | 0.14 | -0.42 | 0.08 | -0.28 | 0.11 |
| 456 | AUS1493 | 0 | | -0.44 | 0.10 | -0.59 | 0.09 | -0.55 | 0.11 | -0.37 | 0.12 | -0.33 | 0.14 | -0.19 | 0.17 |
| 10 | AUS1233 | 0 | | -0.68 | 0.06 | -0.84 | 0.13 | -0.76 | 0.07 | -0.78 | 0.12 | -0.78 | 0.14 | -0.52 | 0.05 |
| 455 | AUS1492 | 0 | | -0.91 | 0.15 | -1.53 | 0.17 | -1.59 | 0.17 | -1.32 | 0.22 | -0.94 | 0.21 | -0.61 | 0.16 |
| 456 | AUS1493 | 0 | | -0.92 | 0.09 | -1.73 | 0.11 | -1.76 | 0.10 | -1.43 | 0.15 | -0.88 | 0.16 | -0.53 | 0.15 |

FIG. 31

Table 16.12

| SEQ ID NO: | ID | Days post dosing (40 mg/kg, n=3) | | | | | | | | | | | |
| | | 0 | | 3 | | 7 | | 10 | | 14 | | 21 | |
| | | mean | SD | mean | SD | mean | SD | mean | SD | mean | SD | mean | SD |
| 10 | AUS12 33 | 0 | | -1.05 | 0.61 | -1.52 | 1.15 | -1.56 | 1.17 | -1.69 | 1.35 | -1.61 | 1.18 |
| 404 | AUS14 41 | 0 | | -1.02 | 0.02 | -1.66 | 0.05 | -1.62 | 0.13 | -1.64 | 0.18 | -1.13 | 0.17 |
| 429 | AUS14 66 | 0 | | -0.85 | 0.07 | -1.34 | 0.03 | -1.31 | 0.10 | -1.21 | 0.17 | -0.87 | 0.16 |
| 435 | AUS14 72 | 0 | | -0.85 | 0.25 | -1.24 | 0.08 | -1.07 | 0.19 | -0.78 | 0.12 | -0.64 | 0.19 |
| 451 | AUS14 88 | 0 | | -0.74 | 0.13 | -0.54 | 0.18 | -0.55 | 0.12 | -0.56 | 0.10 | -0.35 | 0.18 |
| 452 | AUS14 89 | 0 | | -0.80 | 0.05 | -1.30 | 0.09 | -1.33 | 0.18 | -1.11 | 0.12 | -0.81 | 0.14 |

FIG. 32

Table 16.13

| SEQ ID NO: | ID | Days post dosing (15mg/kg for top three rows; 45mg/kg for bottom 5 rows, n=3-5) | | | | | | | | | | | | | |
|---|---|---|---|---|---|---|---|---|---|---|---|---|---|---|---|
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -0.34 | 0.05 | -0.47 | 0.12 | -0.47 | 0.10 | -0.35 | 0.16 | -0.34 | 0.08 | -0.45 | 0.06 |
| 458 | AUS1495 | 0 | | -0.41 | 0.13 | -0.78 | 0.11 | -0.76 | 0.08 | -0.66 | 0.08 | -0.51 | 0.10 | -0.70 | 0.14 |
| 457 | AUS1494 | 0 | | -0.29 | 0.08 | -0.73 | 0.16 | -0.76 | 0.14 | -0.69 | 0.20 | -0.29 | 0.07 | -0.26 | 0.06 |
| 10 | AUS1233 | 0 | | -0.70 | 0.08 | -1.15 | 0.19 | -1.19 | 0.23 | -1.20 | 0.22 | -0.99 | 0.20 | -0.91 | 0.21 |
| 458 | AUS1495 | 0 | | -0.89 | 0.17 | -1.96 | 0.30 | -1.90 | 0.20 | -1.67 | 0.17 | -1.24 | 0.10 | -1.10 | 0.11 |
| 457 | AUS1494 | 0 | | -0.92 | 0.06 | -2.07 | 0.32 | -1.97 | 0.22 | -2.01 | 0.19 | -1.19 | 0.24 | -1.01 | 0.23 |
| 455 | AUS1492 | 0 | | -1.04 | 0.11 | -2.02 | 0.18 | -2.08 | 0.11 | -2.18 | 0.11 | -1.41 | 0.05 | -1.16 | 0.07 |
| 404 | AUS1441 | 0 | | -1.06 | 0.06 | -2.33 | 0.15 | -2.14 | 0.21 | -2.37 | 0.24 | -1.63 | 0.31 | -1.76 | 0.96 |

FIG. 33

Table 16.14

Days post dosing (15mg/kg for top three rows, 45mg/kg for bottom 5 rows, n=5)

| SEQ ID NO. | ID | 0 mean | 0 SD | 3 mean | 3 SD | 7 mean | 7 SD | 10 mean | 10 SD | 14 mean | 14 SD | 21 mean | 21 SD | 28 mean | 28 SD |
|---|---|---|---|---|---|---|---|---|---|---|---|---|---|---|---|
| 10 | AUS1233 | 0 | | -0.16 | 0.11 | -0.38 | 0.16 | -0.51 | 0.37 | -0.63 | 0.49 | -0.61 | 0.87 | -1.09 | 1.32 |
| 458 | AUS1495 | 0 | | -0.36 | 0.10 | -0.56 | 0.14 | -0.52 | 0.12 | -0.50 | 0.14 | -0.31 | 0.23 | -0.63 | 0.27 |
| 457 | AUS1494 | 0 | | -0.32 | 0.11 | -0.52 | 0.12 | -0.56 | 0.07 | -0.46 | 0.13 | -0.54 | 0.61 | -0.74 | 0.84 |
| 10 | AUS1233 | 0 | | -0.90 | 0.19 | -1.27 | 0.32 | -1.38 | 0.42 | -1.33 | 0.46 | -1.19 | 0.73 | -1.32 | 1.19 |
| 458 | AUS1495 | 0 | | -0.82 | 0.26 | -1.46 | 0.31 | -1.36 | 0.26 | -1.20 | 0.25 | -0.87 | 0.17 | -0.88 | 0.19 |
| 457 | AUS1494 | 0 | | -0.93 | 0.10 | -1.22 | 0.22 | -1.16 | 0.34 | -1.10 | 0.65 | -0.98 | 0.88 | -1.17 | 1.04 |
| 455 | AUS1492 | 0 | | -0.98 | 0.13 | -1.55 | 0.17 | -1.42 | 0.19 | -1.46 | 0.22 | -1.24 | 0.38 | -1.19 | 0.44 |
| 445 | AUS1482 | 0 | | -0.75 | 0.14 | -0.95 | 0.22 | -0.83 | 0.26 | -0.56 | 0.20 | -0.47 | 0.22 | -0.48 | 0.21 |
| 404 | AUS1441 | 0 | | -0.84 | 0.15 | -1.48 | 0.34 | -1.29 | 0.34 | -1.18 | 0.47 | -0.87 | 0.50 | -0.79 | 0.55 |

FIG. 34

Table 16.15

| SEQ ID NO: | ID | Days post dosing (40mg/kg, n=3) | | | | | | | | | | | |
| | | 0 | | 3 | | 7 | | 10 | | 14 | | 21 | |
| | | mean | SD | mean | SD | mean | SD | mean | SD | mean | SD | mean | SD |
| 10 | AUS1 233 | 0 | | -0.33 | 0.05 | -0.41 | 0.06 | -0.34 | 0.05 | -0.32 | 0.06 | -0.18 | 0.12 |
| 642 | AUS1 684 | 0 | | -0.20 | 0.06 | -0.31 | 0.04 | -0.28 | 0.03 | -0.42 | 0.08 | -0.29 | 0.15 |

FIG. 35

Table 16.16

| SEQ ID NO. | ID | Days post dosing (45mg/kg, n=4) | | | | | | | | | | | | | |
|---|---|---|---|---|---|---|---|---|---|---|---|---|---|---|---|
| | | 0 | | 3 | | 7 | | 10 | | 14 | | 21 | | 28 | |
| | | mean | SD | mean | SD | mean | SD | mean | SD | mean | SD | mean | SD | mean | SD |
| 10 | AUS1233 | 0 | | -0.62 | 0.17 | -1.79 | 0.16 | -1.61 | 0.09 | -1.05 | 0.16 | -0.62 | 0.18 | -0.32 | 0.09 |
| 455 | AUS1492 | 0 | | -0.95 | 0.22 | -2.18 | 0.11 | -2.26 | 0.29 | -1.56 | 0.23 | -0.97 | 0.19 | -0.39 | 0.09 |
| 456 | AUS1493 | 0 | | -0.99 | 0.18 | -2.19 | 0.14 | -2.21 | 0.27 | -1.49 | 0.30 | -0.67 | 0.29 | -0.46 | 0.16 |

FIG. 36

Table 16.17

| SEQ ID NO. | ID | Days post dosing (40mg/kg, n=2-4) | | | | | | | | | | | |
|---|---|---|---|---|---|---|---|---|---|---|---|---|---|
| | | 0 | | 3 | | 7 | | 10 | | 14 | | 21 | |
| | | mean | SD | mean | SD | mean | SD | mean | SD | mean | SD | mean | SD |
| 10 | AUS1233 | 0 | | -0.59 | 0.22 | -1.14 | 1.00 | -1.18 | 0.67 | -1.31 | 0.59 | -1.12 | 1.98 |
| 359 | AUS1396 | 0 | | -1.02 | 0.52 | -1.67 | 0.36 | -2.06 | 0.51 | -2.06 | 0.75 | -2.44 | 1.49 |
| 385 | AUS1422 | 0 | | -1.06 | 0.93 | -1.92 | 2.03 | -1.51 | 1.96 | -2.75 | 0.39 | -1.69 | 2.29 |
| 386 | AUS1423 | 0 | | -2.21 | 1.65 | -1.54 | 0.53 | -1.94 | 1.01 | -1.92 | 2.09 | -2.53 | 0.94 |
| 387 | AUS1424 | 0 | | -1.92 | 1.43 | -2.44 | 0.95 | -2.26 | 1.53 | -1.77 | 0.26 | -1.84 | 0.57 |
| 388 | AUS1425 | 0 | | -0.90 | 0.06 | -1.23 | 0.24 | -1.00 | 0.15 | -2.65 | 1.17 | -0.92 | 0.57 |
| 389 | AUS1426 | 0 | | -0.88 | 0.22 | -1.12 | 0.45 | -0.80 | 0.54 | -2.05 | 1.38 | -1.35 | 1.01 |
| 390 | AUS1427 | 0 | | -1.65 | 0.04 | -3.22 | 0.03 | -4.49 | 0.44 | -1.07 | 0.56 | -4.13 | 0.27 |
| 391 | AUS1428 | 0 | | -1.73 | 0.96 | -3.78 | 1.00 | -4.35 | 0.45 | -3.74 | 0.48 | -4.43 | 0.65 |
| 392 | AUS1429 | 0 | | -1.15 | 0.21 | -2.60 | 1.53 | -3.07 | 1.54 | -3.64 | 0.42 | -2.71 | 1.35 |
| 393 | AUS1430 | 0 | | -1.35 | 0.97 | -1.65 | 0.91 | -1.49 | 1.33 | -2.41 | 0.78 | -1.20 | 1.09 |
| 394 | AUS1431 | 0 | | -1.00 | 0.40 | -1.09 | 0.64 | -1.40 | 1.23 | -1.53 | 1.21 | -2.24 | 1.26 |
| 395 | AUS1432 | 0 | | -1.48 | 0.82 | -1.58 | 0.51 | -1.79 | 0.83 | -1.70 | 0.91 | -1.68 | 0.74 |
| 396 | AUS1433 | 0 | | -1.62 | 0.31 | -1.90 | 0.41 | -1.73 | 0.41 | -1.75 | 0.60 | -2.07 | 1.76 |

FIG. 37

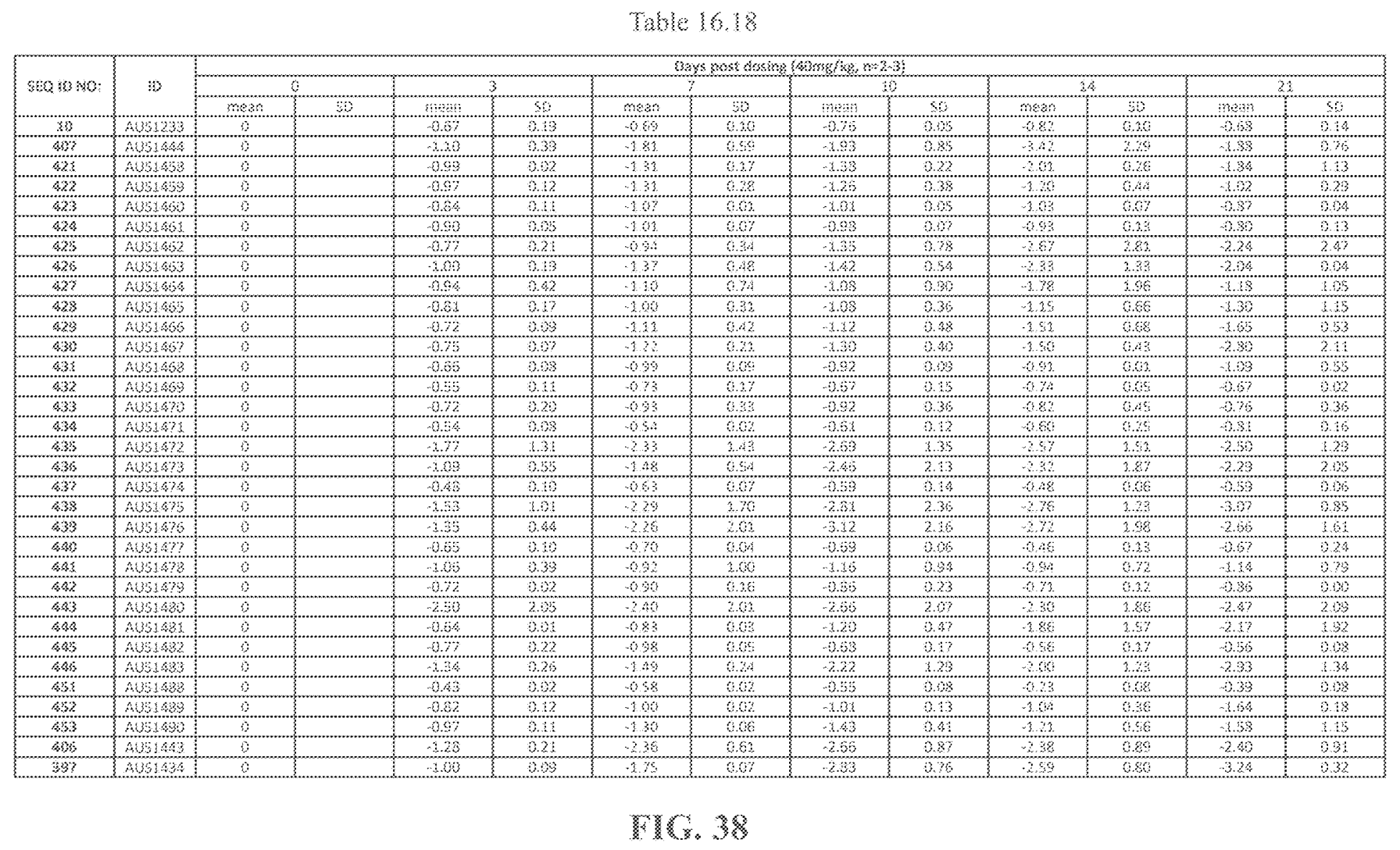

Table 16.18

| SEQ ID NO: | ID | Days post dosing (60mg/kg, n=2-3) | | | | | | | | | | | |
|---|---|---|---|---|---|---|---|---|---|---|---|---|---|
| | | 0 | | 3 | | 7 | | 10 | | 14 | | 21 | |
| | | mean | SD | mean | SD | mean | SD | mean | SD | mean | SD | mean | SD |
| 10 | AU51233 | 0 | | | | | | | | | | | |
| 407 | AU51444 | 0 | | -0.67 | 0.19 | -0.69 | 0.60 | -0.76 | 0.05 | -0.82 | 0.60 | -0.63 | 0.14 |
| 421 | AU51458 | 0 | | -1.30 | 0.39 | -1.81 | 0.59 | -1.93 | 0.85 | -3.42 | 7.29 | -1.98 | 0.76 |
| 422 | AU51459 | 0 | | -0.99 | 0.92 | -1.31 | 0.17 | -1.33 | 0.22 | -1.41 | 0.26 | -1.84 | 1.13 |
| 423 | AU51460 | 0 | | -0.97 | 0.12 | -1.07 | 0.28 | -1.26 | 0.38 | -1.20 | 0.44 | -1.02 | 0.23 |
| 424 | AU51461 | 0 | | -0.64 | 0.11 | -1.01 | 0.05 | -1.01 | 0.05 | -1.03 | 0.07 | -0.97 | 0.04 |
| 425 | AU51462 | 0 | | -0.90 | 0.05 | -0.91 | 0.07 | -0.93 | 0.07 | -0.93 | 0.13 | -0.80 | 0.13 |
| 426 | AU51463 | 0 | | -0.77 | 0.21 | -0.94 | 0.34 | -1.35 | 0.78 | -2.67 | 2.61 | -2.24 | 2.47 |
| 427 | AU51464 | 0 | | -1.09 | 0.19 | -1.37 | 0.48 | -1.42 | 0.54 | -1.33 | 1.39 | -2.04 | 0.04 |
| 428 | AU51465 | 0 | | -0.94 | 0.42 | -1.10 | 0.74 | -1.05 | 0.90 | -1.78 | 1.96 | -1.18 | 1.05 |
| 429 | AU51466 | 0 | | -0.61 | 0.17 | -1.00 | 0.33 | -1.08 | 0.36 | -1.15 | 0.66 | -1.30 | 1.15 |
| 430 | AU51467 | 0 | | -0.72 | 0.09 | -1.11 | 0.42 | -1.12 | 0.48 | -1.51 | 0.68 | -1.65 | 0.53 |
| 431 | AU51468 | 0 | | -0.75 | 0.07 | -1.12 | 0.23 | -1.30 | 0.40 | -1.50 | 0.43 | -2.80 | 2.11 |
| 432 | AU51469 | 0 | | -0.65 | 0.09 | -0.99 | 0.09 | -0.92 | 0.09 | -0.91 | 0.03 | -1.09 | 0.55 |
| 433 | AU51470 | 0 | | -0.55 | 0.11 | -0.73 | 0.37 | -0.57 | 0.15 | -0.82 | 0.45 | -0.67 | 0.02 |
| 434 | AU51471 | 0 | | -0.72 | 0.29 | -0.93 | 0.36 | -0.92 | 0.36 | -0.60 | 0.25 | -0.76 | 0.36 |
| 435 | AU51472 | 0 | | -0.54 | 0.08 | -0.51 | 0.02 | -0.51 | 0.12 | -0.60 | 0.25 | -0.51 | 0.16 |
| 436 | AU51473 | 0 | | -1.77 | 1.31 | -2.33 | 1.48 | -2.68 | 1.35 | -2.57 | 1.51 | -2.50 | 1.28 |
| 437 | AU51474 | 0 | | -1.09 | 0.55 | -1.48 | 0.54 | -2.46 | 2.13 | -3.32 | 1.87 | -2.29 | 2.05 |
| 438 | AU51475 | 0 | | -0.46 | 0.10 | -0.65 | 0.07 | -0.39 | 0.14 | -0.48 | 0.36 | -0.53 | 0.06 |
| 439 | AU51476 | 0 | | -1.53 | 1.01 | -2.29 | 1.70 | -2.61 | 2.36 | -2.78 | 1.23 | -3.97 | 0.85 |
| 440 | AU51477 | 0 | | -1.35 | 0.44 | -2.26 | 2.03 | -3.12 | 2.16 | -2.72 | 1.98 | -2.66 | 1.61 |
| 441 | AU51478 | 0 | | -0.65 | 0.10 | -0.70 | 0.04 | -0.68 | 0.06 | -0.46 | 0.13 | -0.67 | 0.24 |
| 442 | AU51479 | 0 | | -1.06 | 0.39 | -0.92 | 1.00 | -1.16 | 0.94 | -0.94 | 0.72 | -1.14 | 0.79 |
| 443 | AU51480 | 0 | | -0.72 | 0.02 | -0.90 | 0.46 | -0.66 | 0.23 | -0.71 | 0.11 | -0.36 | 0.00 |
| 444 | AU51481 | 0 | | -2.30 | 2.05 | -2.60 | 2.01 | -2.06 | 2.07 | -1.50 | 1.86 | -2.47 | 2.09 |
| 445 | AU51482 | 0 | | -0.64 | 0.01 | -0.83 | 0.05 | -1.20 | 0.47 | -1.86 | 1.57 | -2.17 | 1.92 |
| 446 | AU51483 | 0 | | -0.77 | 0.22 | -0.98 | 0.05 | -0.63 | 0.17 | -0.56 | 0.17 | -0.56 | 0.08 |
| 451 | AU51488 | 0 | | -1.34 | 0.26 | -1.49 | 0.24 | -2.22 | 1.23 | -2.00 | 1.23 | -2.33 | 1.34 |
| 452 | AU51489 | 0 | | -0.43 | 0.02 | -0.58 | 0.02 | -0.55 | 0.08 | -0.23 | 0.08 | -0.39 | 0.08 |
| 453 | AU51490 | 0 | | -0.82 | 0.12 | -1.00 | 0.00 | -1.01 | 0.13 | -1.04 | 0.36 | -1.64 | 0.18 |
| 406 | AU51443 | 0 | | -0.97 | 0.11 | -1.30 | 0.56 | -1.43 | 0.41 | -1.71 | 0.56 | -1.58 | 1.15 |
| 397 | AU51434 | 0 | | -1.28 | 0.21 | -1.75 | 0.07 | -2.33 | 0.76 | -2.59 | 0.80 | -3.24 | 0.32 |

FIG. 38

Table 17

| SEQ ID NO: | ID | Days post dosing (40mg/kg, n=4) | | | | | | | | | | | | | |
| | | 0 | | 3 | | 7 | | 10 | | 14 | | 21 | | 28 | |
| | | mean | SD | mean | SD | mean | SD | mean | SD | mean | SD | mean | SD | mean | SD |
| HBsAg | | | | | | | | | | | | | | | |
| 10 | AUS1 233 | 0 | | -0.52 | 0.04 | -0.66 | 0.03 | -0.61 | 0.03 | -0.54 | 0.03 | -0.30 | 0.05 | -0.22 | 0.05 |
| 456 | AUS1 493 | 0 | | -0.71 | 0.10 | -1.36 | 0.13 | -1.25 | 0.19 | -1.12 | 0.10 | -0.72 | 0.04 | -0.46 | 0.03 |
| HBeAg | | | | | | | | | | | | | | | |
| 10 | AUS1 233 | 0 | | -0.63 | 0.02 | -0.79 | 0.04 | -0.75 | 0.05 | -0.59 | 0.04 | -0.44 | 0.06 | -0.35 | 0.07 |
| 456 | AUS1 493 | 0 | | -1.00 | 0.09 | -1.31 | 0.08 | -1.25 | 0.05 | -1.02 | 0.05 | -0.77 | 0.02 | -0.57 | 0.01 |
| HBV DNA | | | | | | | | | | | | | | | |
| 10 | AUS1 233 | 0 | | -0.62 | 0.15 | -1.32 | 0.14 | -1.46 | 0.28 | -1.23 | 0.15 | -0.99 | 0.13 | -0.62 | 0.13 |
| 456 | AUS1 493 | 0 | | -0.85 | 0.33 | -1.88 | 0.20 | -2.24 | 0.41 | -2.37 | 0.13 | -1.86 | 0.14 | -1.29 | 0.15 |

FIG. 39

Table 18.1

| SEQ ID NO: | ID | Days post dosing (60mg/kg, n=4) | | | | | |
|---|---|---|---|---|---|---|---|
| | | 5 geomean | 7 geomean | 10 geomean | 14 geomean | 17 geomean | 21 geomean |
| 10 | AUS1133 | 7.60 | 11.23 | 6.74 | 13.40 | 51.54 | 34.22 |
| 397 | AUS1434 | 9.84 | 18.54 | 236.96 | 298.39 | | 9.24 |
| 398 | AUS1435 | 8.76 | 38.98 | 230.91 | 318.45 | | 7.18 |
| 403 | AUS1440 | 10.87 | 16.23 | 80.49 | 277.92 | | 16.53 |
| 399 | AUS1436 | 14.15 | 181.88 | 230.62 | 117.80 | | 4.87 |
| 400 | AUS1437 | 11.19 | 30.05 | 191.18 | 137.67 | | 4.87 |
| 401 | AUS1438 | 10.14 | 30.67 | 347.02 | 238.82 | | 4.39 |
| 402 | AUS1439 | 9.78 | 11.06 | 89.09 | 321.05 | | 5.72 |
| 404 | AUS1441 | 15.27 | 12.91 | 15.55 | 28.33 | 72.37 | 5.04 |
| 163 | AUS1178 | 11.52 | 9.80 | 17.13 | 161.86 | | 16.76 |
| 175 | AUS1190 | 8.52 | 8.78 | 15.55 | 166.77 | | 11.84 |
| 173 | AUS1188 | 10.96 | 13.67 | 17.51 | 159.60 | | 12.16 |
| 177 | AUS1192 | 9.84 | 10.10 | 23.62 | 210.64 | | 13.91 |
| 385 | AUS1422 | 8.11 | 8.48 | 31.33 | 96.02 | | 9.65 |
| 386 | AUS1423 | 8.21 | 11.79 | 72.31 | 200.99 | | 11.67 |
| 387 | AUS1424 | 8.76 | 10.40 | 17.29 | 44.09 | 140.54 | 10.02 |
| 388 | AUS1425 | 7.24 | 10.68 | 25.48 | 93.02 | | 9.91 |
| 389 | AUS1426 | 6.07 | 10.36 | 15.89 | 26.59 | 53.62 | 9.16 |
| 390 | AUS1427 | 9.52 | 10.81 | 23.28 | 32.21 | 41.39 | 10.41 |
| 391 | AUS1428 | 11.59 | 11.74 | 28.52 | 161.42 | | 8.46 |
| 392 | AUS1429 | 15.61 | 9.81 | 5.36 | 14.32 | 6.49 | 6.38 |
| 393 | AUS1430 | 12.48 | 7.99 | 22.59 | 288.26 | | 9.01 |
| 394 | AUS1431 | 10.37 | 9.79 | 9.81 | 12.11 | 40.99 | 5.11 |
| 395 | AUS1432 | 12.36 | 9.54 | 21.68 | 103.02 | | 7.36 |
| 396 | AUS1433 | 12.13 | 59.64 | 55.17 | 127.75 | | 9.28 |
| 329 | AUS1360 | 16 | 9 | 20 | 58 | 18 | 11 |
| 364 | AUS1401 | 17 | 10 | 16 | 97 | | 20 |
| 330 | AUS1361 | 11 | 12 | 67 | 48 | 5 | 9 |
| 331 | AUS1362 | 14 | 8 | 40 | 45 | 5 | 9 |
| 374 | AUS1411 | 354 | 301 | | | | |

FIG. 40

Table 18.2

| SEQ ID NO: | ID | Days post dosing (60mg/kg, n=3) | | | | | | |
|---|---|---|---|---|---|---|---|---|
| | | 5 geomean | 7 geomean | 10 geomean | 14 geomean | 17 geomean | 21 geomean |
| 406 | AUS1443 | 9.94 | 9.47 | 19.87 | 71.87 | 153.49 | 27.90 |
| 407 | AUS1444 | 18.98 | 11.76 | 8.00 | 24.40 | 76.12 | 18.76 |
| 408 | AUS1445 | 24.28 | 17.71 | 190.68 | 85.07 | 19.56 | 13.93 |
| 409 | AUS1446 | 10.36 | 8.23 | 9.89 | 12.53 | 19.08 | 15.93 |
| 410 | AUS1447 | 13.62 | 8.40 | 13.18 | 7.62 | 13.48 | 14.15 |
| 411 | AUS1448 | 14.96 | 9.90 | 8.93 | 8.48 | 7.79 | 11.13 |
| 412 | AUS1449 | 11.38 | 7.42 | 9.87 | 11.38 | 8.37 | 7.21 |
| 413 | AUS1450 | 9.94 | 8.48 | 7.82 | 11.18 | 9.49 | 8.08 |
| 415 | AUS1452 | 12.89 | 6.34 | 8.79 | 9.52 | 8.85 | 10.64 |
| 416 | AUS1453 | 12.27 | 7.55 | 7.96 | 9.47 | 9.49 | 9.03 |
| 417 | AUS1454 | 11.68 | 6.12 | 8.77 | 20.95 | 35.05 | 18.72 |
| 418 | AUS1455 | 9.74 | 5.96 | 11.35 | 26.56 | 38.66 | 17.80 |
| 419 | AUS1456 | 10.85 | 7.37 | 11.41 | 12.55 | 19.15 | 11.59 |
| 420 | AUS1457 | 9.52 | 8.13 | 8.88 | 10.04 | 9.51 | 7.47 |

FIG. 41

OLIGONUCLEOTIDES COMPRISING SEGMENTED GAP STRUCTURES

RELATED APPLICATIONS

This application is a continuation of International Application No. PCT/2023/000030, filed Jan. 10, 2023, which claims the priority and benefit of U.S. Provisional Application No. 63/298,092, filed on Jan. 10, 2022, the contents of each of which are incorporated herein in its entirety.

REFERENCE TO AN ELECTRONIC SEQUENCE LISTING

The contents of the electronic sequence listing (AUSB_001_02WO_SeqList_ST26.xml; Size: 6,541,014 bytes; and Date of Creation: Jun. 7, 2024) are herein incorporated by reference in its entirety.

BACKGROUND

Hepatitis B is a viral disease transmitted parenterally by contaminated material such as blood and blood products, contaminated needles, sexually and vertically from infected or carrier mothers to their offspring. It is estimated by the World Health Organization that more than 2 billion people have been infected worldwide, with about 4 million acute cases per year, 1 million deaths per year, and 350-400 million chronic carriers (World Health Organization: Geographic Prevalence of Hepatitis B Prevalence, 2004. http://www.who.int/vaccines-surveillance/graphics/htmls/hepb-prev.htm).

The virus, HBV, is a double-stranded hepatotropic virus which infects only humans and non-human primates. Viral replication takes place predominantly in the liver and, to a lesser extent, in the kidneys, pancreas, bone marrow and spleen (Hepatitis B virus biology. Microbiol Mol Biol Rev. 64:2000; 51-68.). Viral and immune markers are detectable in blood and characteristic antigen-antibody patterns evolve over time. The first detectable viral marker is HBsAg, followed by hepatitis B e antigen (HBeAg) and HBV DNA. Titers may be high during the incubation period, but HBV DNA and HBeAg levels begin to fall at the onset of illness and may be undetectable at the time of peak clinical illness (Hepatitis B virus infection-natural history and clinical consequences. N Engl J Med., 350:2004; 1118-1129). HBeAg is a viral marker detectable in blood and correlates with active viral replication, and therefore high viral load and infectivity (Hepatitis B e antigen—the dangerous end game of hepatitis B. N Engl J Med. 347:2002; 208-210). The presence of anti-HBsAb and anti-HBcAb (IgG) indicates recovery and immunity in a previously infected individual.

Currently the recommended therapies for chronic HBV infection by the American Association for the Study of Liver Diseases (AASLD) and the European Association for the Study of the Liver (EASL) include interferon alpha (INFα), pegylated interferon alpha-2a (Peg-IFN2a), entecavir, and tenofovir. The nucleoside and nucleotide therapies, entecavir and tenofovir, are successful at reducing viral load, but the rates of HBeAg seroconversion and HBsAg loss are even lower than those obtained using IFNa, therapy. Other similar therapies, including lamivudine (3TC), telbivudine (LdT), and adefovir are also used, but for nucleoside/nucleotide therapies in general, the emergence of resistance limits therapeutic efficacy.

Thus, there is a need in the art to discover and develop new anti-viral therapies. Additionally, there is a need for new anti-HBV therapies capable of increasing HBeAg and HBsAg seroconversion rates. Recent clinical research has found a correlation between seroconversion and reductions in HBeAg (Fried et al (2008) Hepatology 47:428) and reductions in HBsAg (Moucari et al (2009) Hepatology 49:1151). Reductions in antigen levels may have allowed immunological control of HBV infection because high levels of antigens are thought to induce immunological tolerance. Current nucleoside therapies for HBV are capable of dramatic reductions in serum levels of HBV but have little impact on HBeAg and HBsAg levels.

Antisense technology is emerging as an effective means for reducing the expression of specific gene products and may therefore prove to be uniquely useful in a number of therapeutic, diagnostic. Antisense therapy differs from nucleoside therapy in that it can directly target the transcripts for the HBV antigens and thereby reduce serum HBeAg and HBsAg levels. Because of the multiple, overlapping transcripts produced upon HBV infection, there is also an opportunity for a single antisense oligomer to reduce HBV DNA in addition to both HBeAg and HBsAg. Therefore, antisense technology is emerging as an effective means for reducing the expression of certain gene products and may therefore prove to be uniquely useful in a number of therapeutic, diagnostic, and research applications for the modulation of HBV.

HBV antisense oligonucleotides which possess a single gap segment flanked directly between a 5' wing segment, and a 3' wing segment have been developed (WO 2012/145697). However, many of the HBV antisense oligonucleotides with this structure exhibited minimal efficacy in reducing serum HBsAg level and/or caused safety concerns in Chronic Hepatitis B patients. Thus there exists a need in the art for improved HBV antisense oligonucleotides.

SUMMARY

The present disclosure extends the principles of HBV antisense oligonucleotides by providing enhanced modified oligonucleotide structures that provide further segmented gap structures, with the use of one or more Separators.

The present disclosure is based, at least in part, on the finding that a discontinuous gap segment flanked between a 5' wing segment and a 3' wing segment in a modified oligonucleotide provides improved activity over conventional anti-sense oligonucleotides that have a continuous gap (e.g., reduction of serum HBsAg levels or HBeAg levels). One or more separator segments placed directly in between gap segments can provide improved activity of the antisense oligonucleotide, which is distinct from the current teachings in the art, which show that separator segments can lead to poor activity. The inventors have unexpectedly discovered that the placement of separator segments at specific positions of the full length anti-sense oligonucleotide provides improved activity, while separator segments in other positions results in reduced activity or no changes to activity. Further, only specific types of nucleoside modifications in the separator segments provide improved activity, while other types of nucleoside modifications in the separator segments results in reduced activity or no changes to activity. Without being bound by theory, the specific combination of nucleoside modification and positioning of the separator segment within the full length anti-sense oligonucleotide, improves binding and activity of RNAse H endonuclease, without compromising the complementarity to the HBV target sequence.

The present disclosure is based, at least in part, on the finding that specific nucleoside modifications of the 5' wing segment and 3' wing segment decrease in vivo toxicity (e.g., reduction in ALT levels, a proxy for liver toxicity, or CC30 (cytotoxic concentration to reduce cell viability by 30%)). The inventors have unexpectedly discovered specific types of modified nucleosides in the 5' wing segment causes increased in vivo toxicity, whereas specific types of modified nucleosides in the 3' wing segment decreased in vivo toxicity. Further, the positioning of the modified nucleosides within the 5' wing segment and 3' wing segment also contribute to in vivo toxicity. Without being bound by theory, the specific combination of nucleoside modification and positioning within the 5' wing segment and the 3' wing segment, contributes to the complementarity of the full length anti-sense oligonucleotide to the HBV target sequence. While the combination of specific types of modifications of at certain positions improves complementarity, other combinations of specific types of modifications and positions lowers complementarity, causing increased off-target binding, which ultimately leads to toxicity.

Provided herein are methods, compounds, and compositions for modulating expression of HBV mRNA and protein. In certain embodiments, compounds useful for modulating expression of HBV mRNA and protein are antisense compounds. In certain embodiments, the antisense compounds are antisense oligonucleotides.

In certain embodiments, modulation can occur in a cell or tissue. In certain embodiments, the cell or tissue is in an animal. In certain embodiments, the animal is a human. In certain embodiments, HBV mRNA levels are reduced. In certain embodiments, HBV DNA levels are reduced. In certain embodiments, HBV protein levels are reduced. In certain embodiments, HBV antigen levels are reduced. In certain embodiments, HBV s-antigen (HBsAg) levels are reduced. In certain embodiments, HBV e-antigen (HBeAg) levels are reduced. Such reduction can occur in a time-dependent manner or in a dose-dependent manner.

Also provided are methods, compounds, and compositions useful for preventing, treating, and ameliorating diseases, disorders, and conditions. In certain embodiments, such HBV related diseases, disorders, and conditions are liver diseases. In certain embodiments, such liver diseases, disorders, and conditions includes jaundice, liver cancer, liver inflammation, liver fibrosis, inflammation, liver cirrhosis, liver failure, diffuse hepatocellular inflammatory disease, hemophagocytic syndrome, serum hepatitis, HBV viremia, and liver disease-related transplantation. In certain embodiments, such HBV related diseases, disorders, and conditions are hyperproliferative diseases, disorders, and conditions. In certain embodiments such hyperproliferative diseases, disorders, and conditions include cancer as well as associated malignancies and metastases. In certain embodiments, such cancers include liver cancer and hepatocellular cancer (HCC).

Such diseases, disorders, and conditions can have one or more risk factors, causes, or outcomes in common. Certain risk factors and causes for development of liver disease or a hyperproliferative disease include growing older; tobacco use; exposure to sunlight and ionizing radiation; contact with certain chemicals; infection with certain viruses and bacteria; certain hormone therapies; family history of cancer; alcohol use; and certain lifestyle choices including poor diet, lack of physical activity, and/or being overweight. Certain symptoms and outcomes associated with development of a liver disease or a hyperproliferative disease include but are not limited to: flu-like illness, weakness, aches, headache, fever, loss of appetite, diarrhea, jaundice, nausea and vomiting, pain over the liver area of the body, clay- or grey-colored stool, itching all over, and dark-colored urine.

In certain embodiments, methods of treatment include administering a HBV antisense compound to an individual in need thereof. In certain embodiments, methods of treatment include administering a HBV antisense oligonucleotide to an individual in need thereof.

BRIEF DESCRIPTION OF THE DRA WINGS

FIG. 1 provides a legend for the nucleoside modifications at each position of the sequences shown in FIGS. 2A-2AI. The column "Examples" describes each type of nucleoside modification.

Figure 2A:
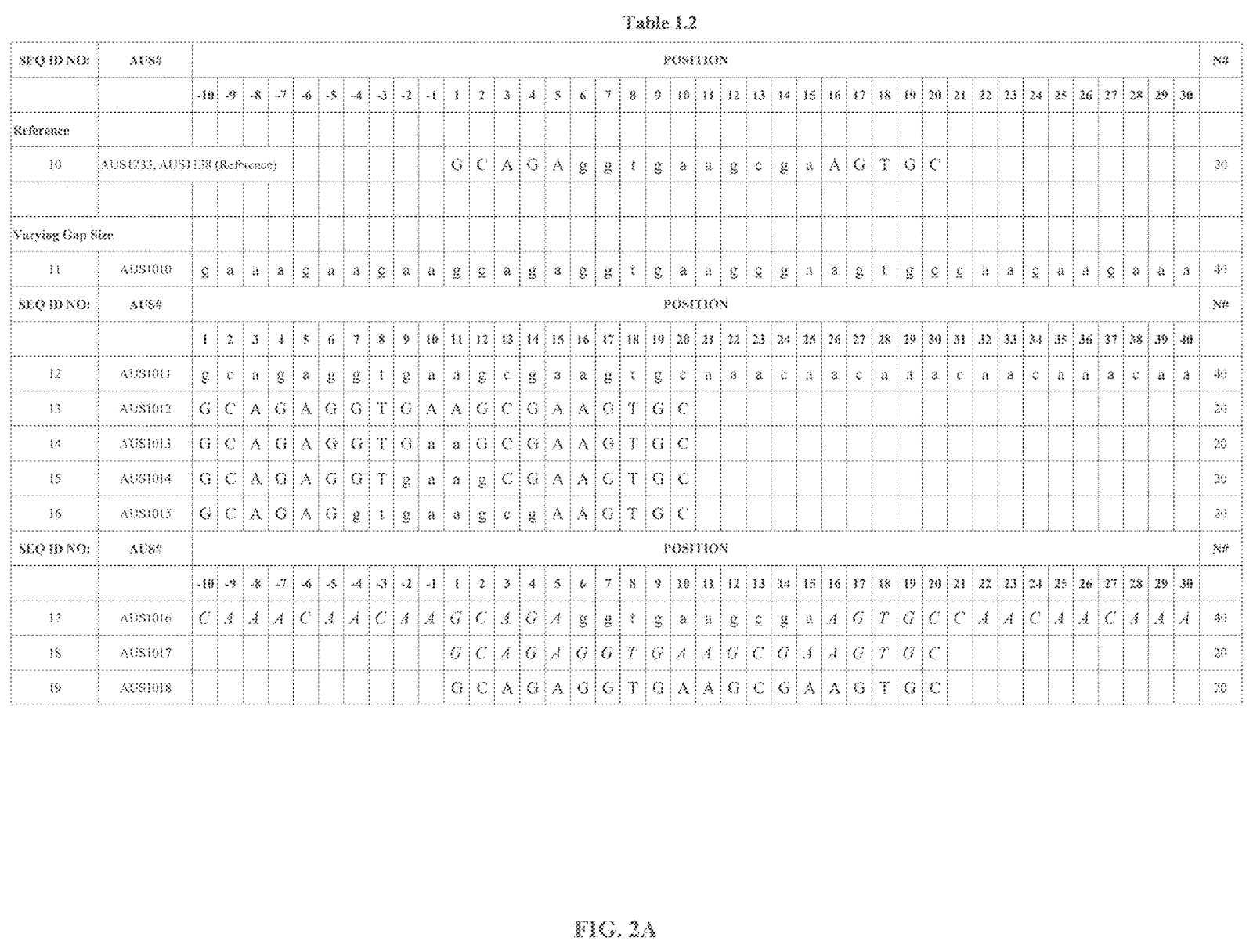
Figure 2K:
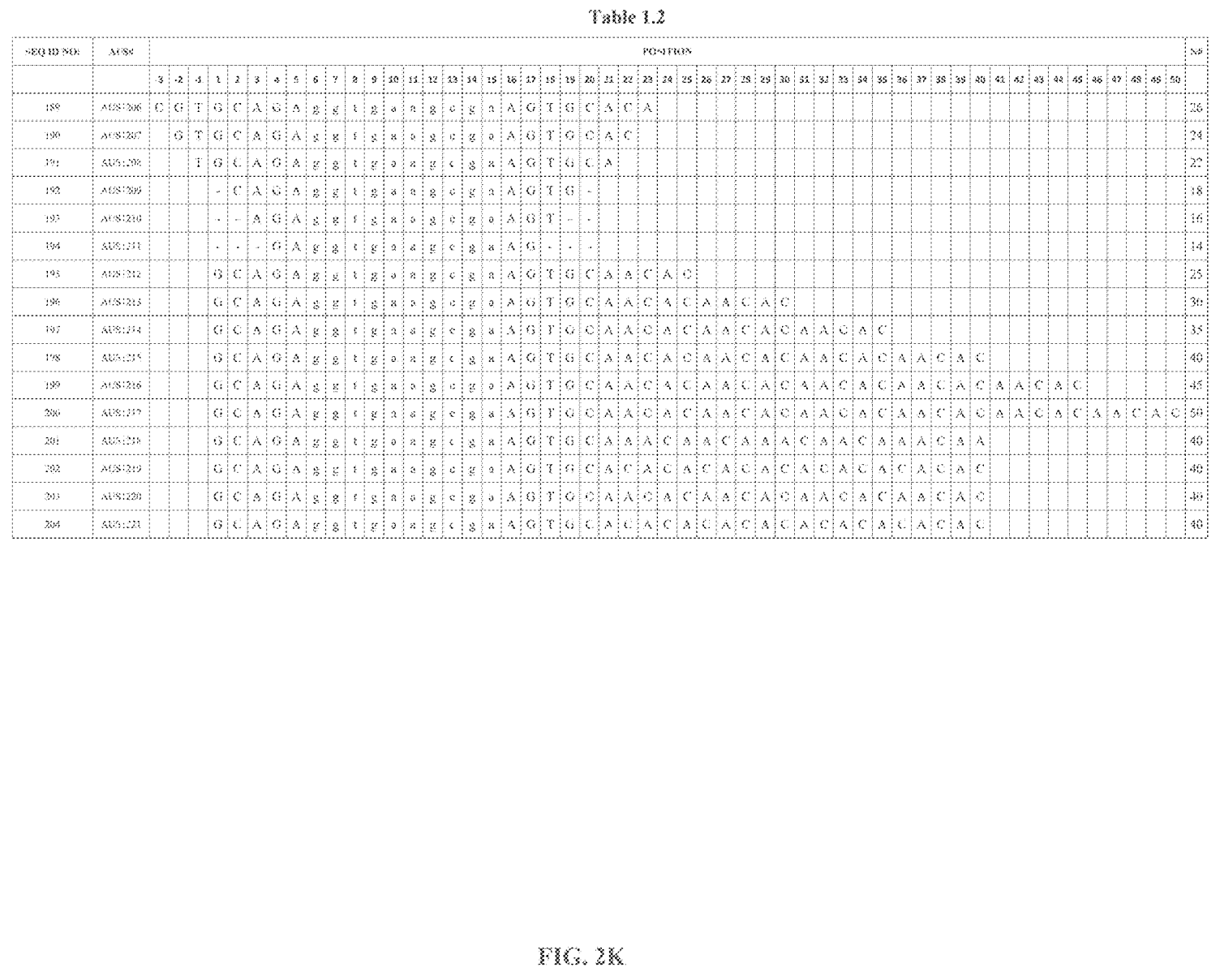

FIGS. 2A-2AI show a table of exemplary modified oligonucleotides of the disclosure. The modifications at each position of the modified oligonucleotide sequences are read using the legend in FIG. 1. AUS1010 to AUS1714 (SEQ ID NO: 11 to SEQ ID NO: 666) represent the modified oligonucleotide sequences. AUS1233 (SEQ ID NO: 10), also referred to as AUS1138, is a reference modified oligonucleotide sequence. FIG. 2A shows SEQ ID NOS: 10-19. FIG. 2B shows SEQ ID NOS: 20-36. FIG. 2C shows SEQ ID NOS: 37-54. FIG. 2D shows SEQ ID NOS: 55-72. FIG. 2E shows SEQ ID NOS: 73-95. FIG. 2F shows SEQ ID NOS: 96-117. FIG. 2G shows SEQ ID NOS: 118-138. FIG. 2H shows SEQ ID NOS: 139-162. FIG. 2I shows SEQ ID NOS: 163-179. FIG. 2J shows SEQ ID NOS: 180-185. FIG. 2K shows SEQ ID NOS: 189-204. FIG. 2L shows SEQ ID NOS: 205-217. FIG. 2M shows SEQ ID NOS: 218-237. FIG. 2N shows SEQ ID NOS: 238-257. FIG. 2O shows SEQ ID NOS: 258-280. FIG. 2P shows SEQ ID NOS: 281-301. FIG. 2O shows SEQ ID NOS: 302-315. FIG. 2R shows SEQ ID NOS: 316-331. FIG. 2S shows SEQ ID NOS: 332-345. FIG. 2T shows SEQ ID NOS: 346-367. FIG. 2U shows SEQ ID NOS: 368-385. FIG. 2V shows SEQ ID NOS: 386-407. FIG. 2W shows SEQ ID NOS: 408-425. FIG. 2X shows SEQ ID NOS: 426-447. FIG. 2Y shows SEQ ID NOS: 448-465. FIG. 2Z shows SEQ ID NOS: 466-491. FIG. 2AA shows SEQ ID NOS: 492-512. FIG. 2AB shows SEQ ID NOS: 513-542. FIG. 2AC shows SEQ ID NOS: 543-559. FIG. 2AD shows SEQ ID NOS: 560-585. FIG. 2AE shows SEQ ID NOS: 586-609. FIG. 2AF shows SEQ ID NOS: 610-616. FIG. 2AG shows SEQ ID NOS: 621-634. FIG. 2AH shows SEQ ID NOS: 635-656. FIG. 2AI shows SEQ ID NOS: 657-666.

5

Figure 9:
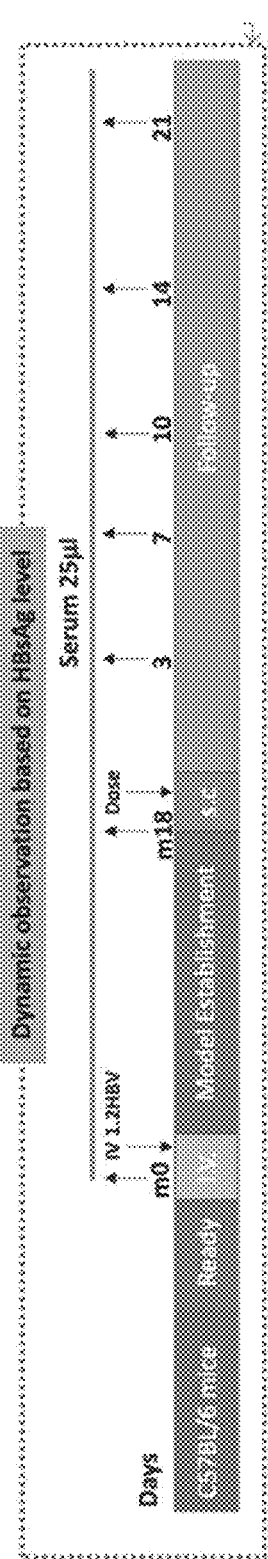

FIG. 9 shows a schematic diagram of an exemplary modified oligonucleotide dosing regimen and HBsAg level sampling schedule for pcDNA3.1-preS2-GTD HDI-HBV mice.

Figure 10:
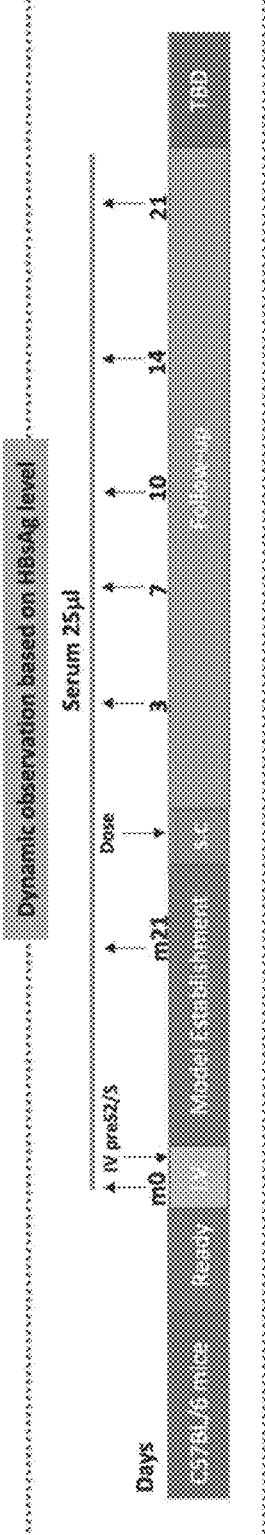

FIG. 10 shows a schematic diagram of an exemplary modified oligonucleotide dosing regimen and HBsAg level sampling schedule for pcDNA3.1-preS2-GTA HDI-HBV mice.

Figure 11:
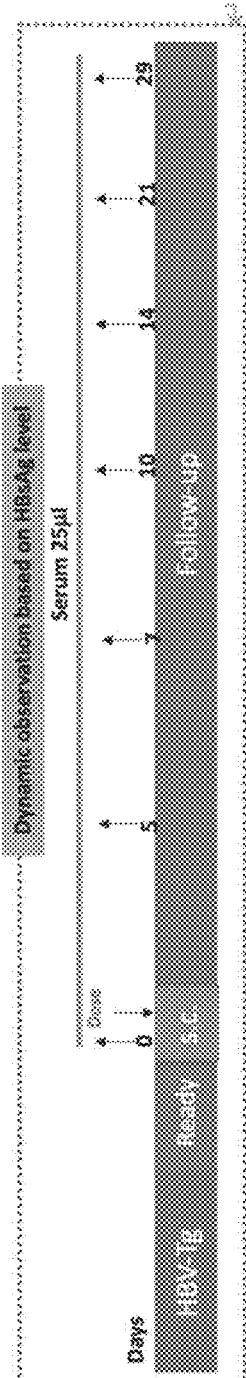

FIG. 11 shows a schematic diagram of an exemplary modified oligonucleotide dosing regimen and HBsAg level sampling schedule for GTA HBV Tg mice.

Figure 12:
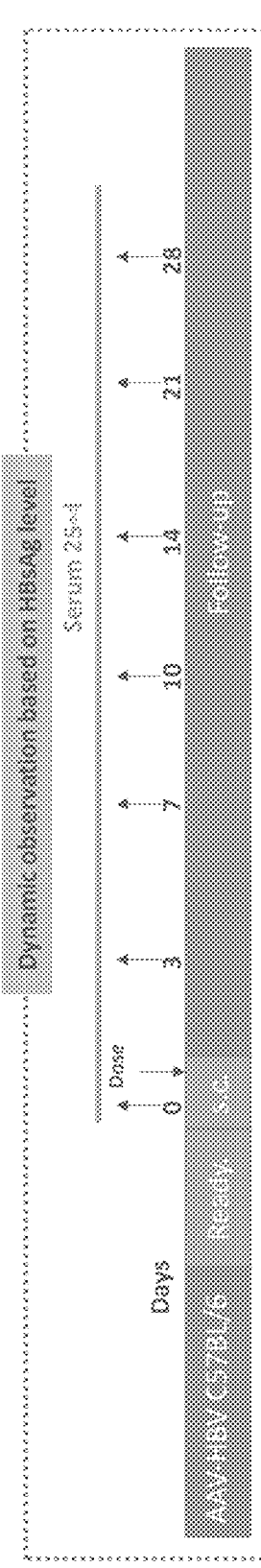

FIG. 12 shows a schematic diagram of an exemplary modified oligonucleotide dosing regimen and HBsAg level sampling schedule for GTD AAV-HBV Tg mice.

Figure 13:
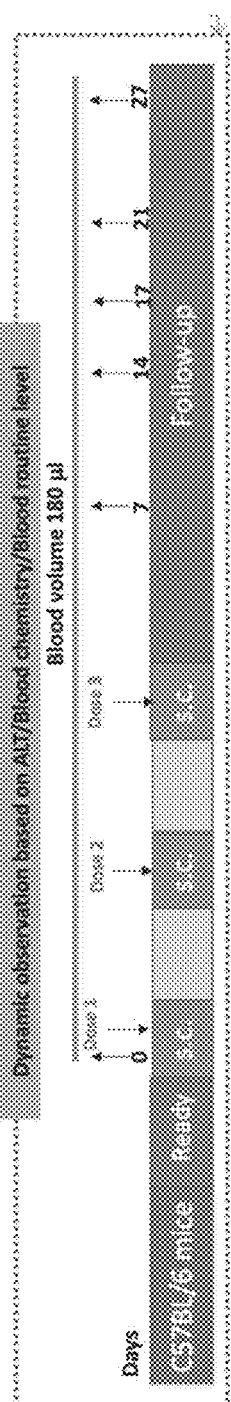

FIG. 13 shows a schematic diagram of an exemplary modified oligonucleotide dosing regimen and lanine aminotransferase (ALT) and aspartate aminotransferase (AST) levels sampling schedule for C57BL/6 Tg mice.

FIG. 14 represents Table 15.1, which shows the serum levels of HBsAg at days 3, 7, 10, 14, 21, and 28 in GT-C 1.0HBV transgenic mice following a 40 mg/kg subcutaneous treatment of the modified oligonucleotides AUS1233, AUS1683, AUS1684, AUS1685, AUS1220, AUS1322, AUS1323, or AUS1324. The mean values are expressed in log 10.

FIG. 15 represents Table 15.2, which shows the serum levels of HBsAg at days 3, 7, 10, 14, 21, and 28 in GT-C 1.0HBV transgenic mice following a 40 mg/kg subcutaneous treatment of the modified oligonucleotides AUS1169, AUS1171, AUS1170, AUS1168, or AUS1322. The mean values are expressed in $log_{10}$.

FIG. 16 represents Table 15.3, which shows the serum levels of HBsAg at days 3, 7, 10, 14, and 21 in GT-C 1.0HBV transgenic mice following a 30 mg/kg subcutaneous treatment of the modified oligonucleotides AUS1434, AUS1435, AUS1440, AUS1436, AUS1437, AUS1438, AUS1439, AUS1441, AUS1422, AUS1423, AUS1424, AUS1425, AUS1426, AUS1427, AUS1428, AUS1429, AUS1430, AUS1431, AUS1432, or AUS1433. The mean values are expressed in log 10.

FIG. 17 represents Table 15.4, which shows the serum levels of HBsAg at days 3, 7, 10, 14, and 21 in GT-C 1.0HBV transgenic mice following a 30 mg/kg subcutaneous treatment of the modified oligonucleotides AUS1463, AUS1466, AUS1476, AUS1472, AUS1489, or AUS1459. The mean values are expressed in log 10.

FIG. 18 represents Table 15.5, which shows the serum levels of HBsAg at days 3, 7, 10, 14, 21, and 28 in GT-C 1.0HBV transgenic mice following a 30 mg/kg subcutaneous treatment of the modified oligonucleotides AUS1492, AUS1495, AUS1494, AUS1493, AUS1482, or AUS1441. The mean values are expressed in $log_{10}$.

FIG. 19 represents Table 15.6, which shows the serum levels of HBsAg at days 3, 7, 10, 14, and 21 in GT-C 1.0HBV transgenic mice following a 40 mg/kg subcutaneous treatment of the modified oligonucleotides AUS1693, AUS1694, AUS1695, AUS1696, AUS1697, AUS1698, AUS1699, or AUS1700. The mean values are expressed in $log_{10}$.

FIG. 20 represents Table 15.7, which shows the serum levels of HBsAg at days 3, 7, 10, 14, 21, and 28 in GT-C 1.0HBV transgenic mice following treatment with modified oligonucleotides. Rows 1 and 2 show HBsAg levels following a 10 mg/kg subcutaneous dose of AUS1493 or AUS1233 on Day 0. Rows 3 and 4 show HBsAg levels following a 30 mg/kg subcutaneous dose of AUS1493 or AUS1233 on Day 0. The mean values are expressed in log 10.

FIG. 21 represents Table 16.1, which shows the serum levels of HBsAg at days 3, 7, 10, 14, 21, and 28 in GT-D HDI HBV mice following a 60 mg/kg subcutaneous treatment of the eASO compound AUS1683, AUS1684, AUS1685, AUS1220, AUS1322, AUS1323, or AUS1324. The mean values are expressed in $log_{10}$.

FIG. 22 represents Table 16.2, which shows the serum levels of HBsAg at days 3, 7, 10, 14, 21, and 28 in GT-D HDI HBV mice following a 60 mg/kg subcutaneous treatment of the eASO compound AUS1169, AUS1171, AUS1170, or AUS1168. The mean values are expressed in $log_{10}$.

FIG. 23 represents Table 16.3, which shows the serum levels of HBsAg at days 3, 7, 10, 14, and 21 in GT-D HDI HBV mice following a 60 mg/kg subcutaneous treatment of the eASO compound AUS1173, AUS1174, AUS1175, or AUS1176. The mean values are expressed in log 10.

FIG. 24 represents Table 16.4, which shows the serum levels of HBsAg at days 3, 7, 10, and 14 in GT-D HDI HBV mice following a 60 mg/kg subcutaneous treatment of the eASO compound AUS1173, AUS1177, AUS1178, AUS1179, AUS1180, AUS1181, AUS1182, AUS1194, AUS1184, AUS1185, AUS1186, AUS1187, AUS1188, AUS1189, AUS1190, AUS1191, AUS1192, AUS1193, AUS1183, AUS1239, AUS1325, AUS1326, AUS1327, AUS1328, AUS1329, AUS1175, AUS1361, or AUS1362. The mean values are expressed in log 10.

FIG. 25 represents Table 16.5, which shows the serum levels of HBsAg at days 3, 7, 10, 14, and 22 in GT-D HDI HBV mice following a 60 mg/kg subcutaneous treatment of the eASO compound AUS1322, AUS1382, AUS1383, AUS1384, or AUS1385. The mean values are expressed in $log_{10}$.

FIG. 26 represents Table 16.6, which shows the serum levels of HBsAg at days 3, 7, 10, 14, and 21 in GT-D HDI HBV mice following a 60 mg/kg subcutaneous treatment of the eASO compound AUS1322, AUS1388, AUS1389, AUS1390, AUS1392, AUS1393, AUS1396, AUS1403, AUS1409, AUS1411, AUS1413, AUS1414, or AUS1415. The mean values are expressed in $log_{10}$.

FIG. 27 represents Table 16.7, which shows the serum levels of HBsAg at days 3, 7, 10, and 14 in GT-D HDI HBV mice following a 60 mg/kg subcutaneous treatment of the eASO compound AUS1387, AUS1326, AUS1328, AUS1388, AUS1390, AUS1403, or AUS1360. The mean values are expressed in log 10.

FIG. 28 represents Table 16.8, which shows the serum levels of HBsAg at days 3, 7, 10, 14, and 21 in GT-D HDI HBV mice following a 40 mg/kg subcutaneous treatment of the eASO compound AUS1434, AUS1435, AUS1440, AUS1436, AUS1437, AUS1438, AUS1439, AUS1441, AUS1422, AUS1423, AUS1424, AUS1425, AUS1426, AUS1427, AUS1428, AUS1429, AUS1430, AUS1431, AUS1432, or AUS1433. The mean values are expressed in log 10.

FIG. 29 represents Table 16.9, which shows the serum levels of HBsAg at days 3, 7, 10, 14, and 21 in GT-D HDI HBV (1.5 ug/ml pcDNA3.1 preS2/S plasmid) mice following a 40 mg/kg subcutaneous treatment of the eASO compound AUS1444, AUS1458, AUS1459, AUS1460, AUS1461, AUS1462, AUS1463, AUS1464, AUS1465, AUS1466, AUS1467, AUS1468, AUS1469, AUS1470, AUS1471, AUS1472, AUS1473, AUS1474, AUS1475, AUS1476, AUS1477, AUS1478, AUS1479, AUS1480, AUS1481, AUS1482, AUS1483, AUS1488, AUS1489, AUS1490, AUS1443, AUS1444, or AUS1445. The mean values are expressed in $log_{10}$.

FIG. 30 represents Table 16.10, which shows the serum levels of HBsAg at days 3, 7, 10, 14, 21, and 28 in GT-D HDI HBV (1.5 ug/ml pcDNA3.1 preS2/S plasmid) mice following a 15 mg/kg or 45 mg/kg subcutaneous treatment of the eASO compound AUS1492, AUS1493, AUS1233, AUS1492, or AUS1493. The mean values are expressed in log 10.

FIG. 31 represents Table 16.11, which shows the serum levels of HBsAg at days 3, 7, 10, 14, 21, and 28 in GT-A HDI HBV (1.5 ug/ml pcDNA3.1 preS2/S plasmid) mice following a 40 mg/kg subcutaneous treatment of the eASO compound AUS1492, AUS1493, AUS1233, AUS1492, or AUS1493. The mean values are expressed in log 10.

FIG. 32 represents Table 16.12, which shows the serum levels of HBsAg at days 3, 7, 10, 14, and 21 in GT-A HDI HBV (1.5 ug/ml pcDNA3.1 preS2/S plasmid) mice following a 15 or 45 mg/kg subcutaneous treatment of the eASO compound AUS1441, AUS1466, AUS1472, AUS1488, or AUS1489. The mean values are expressed in $log_{10}$.

FIG. 33 represents Table 16.13, which shows the serum levels of HBsAg at days 3, 7, 10, 14, 21, and 28 in GT-D HDI HBV (1.5 ug/ml pcDNA3.1 preS2/S plasmid) mice following a 15 or 45 mg/kg subcutaneous treatment of the eASO compound AUS1495, AUS1494, AUS1233, AUS1495, AUS1494, AUS1492, or AUS1441. The mean values are expressed in log 10.

FIG. 34 represents Table 16.14, which shows the serum levels of HBsAg at days 3, 7, 10, 14, 21, and 28 in GT-A HDI HBV (1.5 ug/ml pcDNA3.1 preS2/S plasmid) mice following a 15 or 45 mg/kg subcutaneous treatment of the eASO compound AUS1495, AUS1494, AUS1233, AUS1495, AUS1494, AUS1492, AUS1482, or AUS1441. The mean values are expressed in log 10.

FIG. 35 represents Table 16.15, which shows the serum levels of HBsAg at days 3, 7, 10, 14, and 21 in GT-B HDI HBV (0.5 ug/ml pcDNA3.1 preS2/S plasmid) mice following a 40 mg/kg subcutaneous treatment of the eASO compound AUS1684. The mean values are expressed in log 10.

FIG. 36 represents Table 16.16, which shows the serum levels of HBsAg at days 3, 7, 10, 14, 21, and 28 in GT-A 1.2HBV mice following a 45 mg/kg subcutaneous treatment of the eASO compound AUS1492 or AUS1493. The mean values are expressed in log 10.

FIG. 37 represents Table 16.17, which shows the serum levels of HBsAg at days 3, 7, 10, 14, and 21 in GT-A HDI HBV (1.5 ug/ml pAAV-1.2HBV plasmid) mice following a 40 mg/kg subcutaneous treatment of the eASO compound AUS1396, AUS1422, AUS1423, AUS1424, AUS1425, AUS1426, AUS1427, AUS1428, AUS1429, AUS1430, AUS1431, AUS1432, or AUS1433. The mean values are expressed in log 10.

FIG. 38 represents Table 16.18, which shows the serum levels of HBsAg at days 3, 7, 10, 14, and 21 in GT-A HDI HBV (1.5 ug/ml pAAV-1.2HBV plasmid) mice following a 40 mg/kg subcutaneous treatment of the eASO compound AUS1444, AUS1458, AUS1459, AUS1460, AUS1461, AUS1462, AUS1463, AUS1464, AUS1465, AUS1466, AUS1467, AUS1468, AUS1469, AUS1470, AUS1471, AUS1472, AUS1473, AUS1474, AUS1475, AUS1476, AUS1477, AUS1478, AUS1479, AUS1480, AUS1481, AUS1482, AUS1483, AUS1488, AUS1489, AUS1490, AUS1443, or AUS1434. The mean values are expressed in log 10.

FIG. 39 represents Table 17, which shows the serum levels of HBsAg, HBeAg, and HBV DNA at days 3, 7, 10, 14, 21, and 28 in GT-D AAV HBV (rAAV-HBV1.3-mer WT replicon) mice following a 40 mg/kg subcutaneous treatment of the eASO compound AUS1493. The mean values are expressed in $log_{10}$.

FIG. 40 represents Table 18.1 which shows the serum levels of ALT in WT male C57BL/6 mice at days 5, 7, 10, 14, 17, and 21 following a 60 mg/kg subcutaneous treatment of the eASO compound AUS1434, AUS1435, AUS1440, AUS1436, AUS1437, AUS1438, AUS1439, AUS1441, AUS1178, AUS1190, AUS1188, AUS1192, AUS1422, AUS1423, AUS1424, AUS1425, AUS1426, AUS1427, AUS1428, AUS1429, AUS1430, AUS1431, AUS1432, AUS1433, AUS1360, AUS1401, AUS1361, AUS1362, or AUS1411 on days 0, 2, and 4.

FIG. 41 represents Table 18.2 which shows the serum levels of ALT in WT male C57BL/6 mice at days 5, 7, 10, 14, 17, and 21 following a 60 mg/kg subcutaneous treatment of the eASO compound AUS1443, AUS1444, AUS1445, AUS1446, AUS1447, AUS1448, AUS1449, AUS1450, AUS1452, AUS1453, AUS1454, AUS1455, AUS1456, or AUS1457 on days 0, 2, and 4.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

DEFINITIONS

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and $2'-O(CH_2)_2-OCH_3$) refers to an O-methoxy-ethyl modification at the 2' position of a furanose ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" means a nucleoside comprising a substituent at the 2'-position of the furanosyl ring other than H or OH. In certain embodiments, 2' substituted nucleosides include nucleosides with bicyclic sugar modifications.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within +7% of a value. For example, if it is stated, "the compounds affected at least about 70% inhibition of HBV", it is implied that the HBV levels are inhibited within a range of 63% and 77%.

"Acceptable safety profile" means a pattern of side effects that is within clinically acceptable limits.

"Active pharmaceutical agent" means the substance or substances in a pharmaceutical composition that provide a therapeutic benefit when administered to an individual. For example, in certain embodiments an antisense oligonucleotide targeted to HBV is an active pharmaceutical agent.

"Active target region" means a target region to which one or more active antisense compounds is targeted. "Active antisense compounds" means antisense compounds that reduce target nucleic acid levels or protein levels.

"Acute hepatitis B infection" results when a person exposed to the hepatitis B virus begins to develop the signs and symptoms of viral hepatitis. This period of time, called the incubation period, is an average of 90 days, but could be as short as 45 days or as long as 6 months. For most people this infection will cause mild to moderate discomfort but will go away by itself because of the body's immune response succeeds in fighting the virus. However, some people, particularly those with compromised immune systems, such as persons suffering from AIDS, undergoing chemotherapy, taking immunosuppressant drugs, or taking steroids, have very serious problems as a result of the acute HBV infection, and go on to more severe conditions such as fulminant liver failure.

"Administered concomitantly" refers to the co-administration of two agents in any manner in which the pharmacological effects of both are manifest in the patient at the same time. Concomitant administration does not require that both agents be administered in a single pharmaceutical composition, in the same dosage form, or by the same route of administration. The effects of both agents need not manifest themselves at the same time. The effects need only be overlapping for a period of time and need not be coextensive.

"Administering" means providing a pharmaceutical agent to an individual, and includes, but is not limited to administering by a medical professional and self-administering.

"Agent" means an active substance that can provide a therapeutic benefit when administered to an animal. "First Agent" means a therapeutic compound described herein. For example, a first agent can be an antisense oligonucleotide targeting HBV. "Second agent" means a second therapeutic compound described herein (e.g. a second antisense oligonucleotide targeting HBV) and/or a non-HBV therapeutic compound.

"Amelioration" refers to a lessening of at least one indicator of the severity of a condition or disease. The severity of indicators may be determined by subjective or objective measures which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody" refers to a molecule characterized by reacting specifically with an antigen in some way, where the antibody and the antigen are each defined in terms of the other. Antibody may refer to a complete antibody molecule or any fragment or region thereof, such as the heavy chain, the light chain, Fab region, and Fe region.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, snoRNAs, miRNAs, and satellite repeats.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding region or segment of a target nucleic acid.

The "area under the curve" or "AUC" is the integral of the concentration of a drug in blood plasma as a function of time. The AUC can be determined for the totality of time for which data is available, for example until the drug is no longer detectable ($AUC_{0-t}$), the area under the curve from time 0 extrapolated to infinity ($AUC_{0-¥}$), or for a particular truncated window of time, for example 24 hours after administration ($AUC_{0-24}$).

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar" means a furanose ring modified by the bridging of two non-geminal carbon atoms. A bicyclic sugar is a modified sugar.

"Body weight" refers to an animal's whole body weight, inclusive of all tissues including adipose tissue.

"Cap structure" or "terminal cap moiety" means chemical modifications, which have been incorporated at either terminus of an antisense compound.

"cEt" or "constrained ethyl" means a bicyclic sugar moiety comprising a bridge connecting the 4'-carbon and the 2'-carbon, wherein the bridge has the formula: 4'-CH (CH$_3$)—O-2'.

"Constrained ethyl nucleoside" (also cEt nucleoside) means a nucleoside comprising a bicyclic sugar moiety comprising a 4'-CH(CH$_3$)—O-2' bridge.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Chronic hepatitis B infection" occurs when a person initially suffers from an acute infection but is then unable to fight off the infection. Whether the disease becomes chronic or completely resolves depends mostly on the age of the infected person. About 90% of infants infected at birth will progress to chronic disease. However, as a person ages, the risk of chronic infection decreases such that between 20%-50% of children and less than 10% of older children or adults will progress from acute to chronic infection. Chronic HBV infections are the primary treatment goal for embodiments of the present invention, although ASO compositions of the present invention are also capable of treating HBV-related conditions, such as inflammation, fibrosis, cirrhosis, liver cancer, serum hepatitis, and more.

"Co-administration" means administration of two or more pharmaceutical agents to an individual. The two or more pharmaceutical agents may be in a single pharmaceutical composition, or may be in separate pharmaceutical compositions. Each of the two or more pharmaceutical agents may be administered through the same or different routes of administration. Co-administration encompasses administration in parallel or sequentially.

"Complementarity" means the capacity for pairing between nucleobases of a first nucleic acid and a second nucleic acid.

"Comply" means the adherence with a recommended therapy by an individual.

"Comprise," "comprises" and "comprising" will be understood to imply the inclusion of a stated step or element or group of steps or elements but not the exclusion of any other step or element or group of steps or elements.

"Contiguous nucleobases" means nucleobases immediately adjacent to each other.

"Cure" means a method or course that restores health or a prescribed treatment for an illness.

"Deoxyribonucleotide" means a nucleotide having a hydrogen at the 2' position of the sugar portion of the nucleotide. Deoxyribonucleotides may be modified with any of a variety of substituents.

"Designing" or "Designed to" refer to the process of designing an oligomeric compound that specifically hybridizes with a selected nucleic acid molecule.

"Diluent" means an ingredient in a composition that lacks pharmacological activity, but is pharmaceutically necessary or desirable. For example, in drugs that are injected, the diluent may be a liquid, e.g. saline solution.

"Dosage unit" means a form in which a pharmaceutical agent is provided, e.g. pill, tablet, or other dosage unit known in the art.

"Dose" means a specified quantity of a pharmaceutical agent provided in a single administration, or in a specified time period. In certain embodiments, a dose may be administered in two or more boluses, tablets, or injections. For example, in certain embodiments, where subcutaneous administration is desired, the desired dose requires a volume not easily accommodated by a single injection. In such embodiments, two or more injections may be used to achieve the desired dose. In certain embodiments, a dose may be administered in two or more injections to minimize injection site reaction in an individual. In other embodiments, the pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Duration" means the period of time during which an activity or event continues. In certain embodiments, the duration of treatment is the period of time during which doses of a pharmaceutical agent are administered.

"Effective amount" in the context of modulating an activity or of treating or preventing a condition means the administration of that amount of active ingredient to a subject in need of such modulation, treatment or prophylaxis, either in a single dose or as part of a series, that is effective for modulation of that effect, or for treatment or prophylaxis or improvement of that condition. The effective amount will vary depending upon the health and physical condition of the subject to be treated, the taxonomic group of subjects to be treated, the formulation of the composition, the assessment of the medical situation, and other relevant factors.

"Efficacy" means the ability to produce a desired effect.

"Expression" includes all the functions by which a gene's coded information is converted into structures present and operating in a cell. Such structures include, but are not limited to the products of transcription and translation.

The term "fragment," as applied to a polynucleotide, will be understood to mean a nucleotide sequence of reduced length relative to a reference nucleic acid or nucleotide sequence and comprising, consisting essentially of, and/or consisting of a nucleotide sequence of contiguous nucleotides identical or almost identical (e.g., 60%, 70%, 80%, 90%, 92%, 95%, 98% or 99% identical) to the reference nucleic acid or nucleotide sequence. Such a nucleic acid fragment according to the invention may be, where appropriate, included in a larger polynucleotide of which it is a constituent. In some embodiments, such fragments can comprise, consist essentially of, and/or consist of oligonucleotides having a length of at least about 8, 10, 12, 15, 20, 25, 30, 35, 40, 45, 50, 75, 100, 150, 200, or more consecutive nucleotides of a nucleic acid or nucleotide sequence according to the invention.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Fully modified motif" refers to an antisense compound comprising a contiguous sequence of nucleosides wherein essentially each nucleoside is a sugar modified nucleoside having uniform modification.

"Gapmer" means a chimeric antisense compound in which an internal region having a plurality of nucleosides that support RNase H cleavage is positioned between external regions having one or more nucleosides, wherein the nucleosides comprising the internal region can be chemically distinct from the nucleoside or nucleosides comprising the external regions. The internal region may be referred to as the "gap" and each of the 5' and 3' external regions may be referred to as a "wing."

A "gap" is an internal segment of a chimeric antisense compound that comprises one or more linked deoxynucleosides, and is positioned between a 5' wing (W1) and a 3' wing (W2). A gap may be referred to as a "gap" a "gap region" or a "gap segment".

"HBV" means mammalian hepatitis B virus, including human hepatitis B virus. The term encompasses geographical genotypes of hepatitis B virus, particularly human hepatitis B virus, as well as variant strains of geographical genotypes of hepatitis B virus.

"HBV antigen" means any hepatitis B virus antigen or protein, including core proteins such as "hepatitis B core antigen" or "HBcAG" and "hepatitis B E antigen" or "HBeAG" and envelope proteins such as "HBV surface antigen", or "HBsAg" or "HBSAG".

"Hepatitis B E antigen" or "HBeAg" or "HBeAG" is a secreted, non-particulate form of HBV core protein. HBV antigens HBeAg and HBcAg share primary amino acid sequences, so show cross-reactivity at the T cell level. HBeAg is not required for viral assembly or replication, although studies suggest they may be required for establishment of chronic infection. Neonatal infection with HBeAg-negative mutant often results in fulminant acute rather than chronic HBV infection (Terezawa et al (1991) Pediatr. Res. 29:5), whereas infection of young woodchucks with WHeAg-negative mutant results in a much lower rate of chronic WHV infection (Cote et al (2000) Hepatology 31:190). HBeAg may possibly function as a toleragen by inactivating core specific T cells through deletion or clonal anergy (Milich et al (1998) J. Immunol. 160:8102). There is a positive correlation between reduction of HBV viral load and antigens, and a decrease of expression, by T cells, of the inhibitory receptor programmed death-1 (PD-1; also known as PDCD1), a negative regulator of activated T cells, upon antiviral therapy and HBeAg seroconversion (Evans et al (2008) Hepatology 48:759).

"HBV mRNA" means any messenger RNA expressed by hepatitis B virus.

"HBV nucleic acid" or 'HBV DNA' means any nucleic acid encoding HBV. For example, in certain embodiments, a HBV nucleic acid includes, without limitation, any viral DNA sequence encoding a HBV genome or portion thereof, any RNA sequence transcribed from a viral DNA including any mRNA sequence encoding a HBV protein.

"HBV protein" means any protein secreted by hepatitis B virus The term encompasses various HBV antigens, including core proteins such as "Hepatitis E antigen", "HBeAg" or "HBeAG" and envelope proteins such as "HBV surface antigen", or "HBsAg".

"HBV surface antigen", or "HBsAg", or "HBSAG" is the envelope protein of infectious HBV viral particles but is also secreted as a non-infectious particle with serum levels 1000-fold higher than HBV viral particles. The serum levels of HBsAg in an infected person or animal can be as high as 1000 gg/mL (Kann and Gehrlich (1998) Topley & Wilson's Microbiology and Microbial Infections, 9th ed. 745). In acute HBV infections, the half-life of HBsAg in the serum, or serum tex, is 8.3 days (Chulanov et al (2003) J. Med. Virol. 69:313). Internalization of HBsAg by myeloid dendritic cells inhibits up-regulation of co-stimulatory molecules (i.e. B7) and inhibits T cell stimulatory capacity (den Brouw et al (2008) Immunology 126:280), and dendritic cells from chronically infected patients also show deficits in expression of co-stimulatory molecules, secretion of IL-12, and stimulation of T cells in the presence of HBsAg (Zheng et al (2004) J. Viral Hepatitis 11:217). HBsAg specific CD8 cells from CHB patients show altered tetramer binding. These CD8 cells are not anergic but may have TCR topology that confers partial tolerance or ignorance (Reignat et al (2002) J. Exp. Med. 195:1089). Moreover, reduction in serum HBsAg>1 log at week 24 has a high predictive value (92%) for sustained virological response (SVR-defined as nondetectable HBV DNA by PCR at 1 year after treatment) during Peg-IFNa2a therapy (Moucari et al (2009) Hepatology 49:1151).

"Hepatitis B-related condition" or "HBV-related condition" means any disease, biological condition, medical condition, or event which is exacerbated, caused by, related to, associated with, or traceable to a hepatitis B infection, exposure, or illness. The term hepatitis B-related condition includes chronic HBV infection, inflammation, fibrosis, cirrhosis, liver cancer, serum hepatitis, jaundice, liver cancer, liver inflammation, liver fibrosis, liver cirrhosis, liver failure, diffuse hepatocellular inflammatory disease, hemophagocytic syndrome, serum hepatitis, HBV viremia, liver disease related to transplantation, and conditions having symptoms which may include any or all of the following: flu-like illness, weakness, aches, headache, fever, loss of appetite, diarrhea, nausea and vomiting, pain over the liver area of the body, clay- or grey-colored stool, itching all over, and dark-colored urine, when coupled with a positive test for presence of a hepatitis B virus, a hepatitis B viral antigen, or a positive test for the presence of an antibody specific for a hepatitis B viral antigen.

"Hybridization" means the annealing of complementary nucleic acid molecules. In certain embodiments, complementary nucleic acid molecules include, but are not limited to, an antisense compound and a nucleic acid target. In certain embodiments, complementary nucleic acid molecules include, but are not limited to, an antisense oligonucleotide and a nucleic acid target.

As used herein, the term "IC50" or "$IC_{50}$ value" refers to the concentration of an agent where cell viability is reduced by half. The $IC_{50}$ is thus a measure of the effectiveness of an agent in inhibiting a biological process.

"Identifying an animal having an HBV infection" means identifying an animal having been diagnosed with an HBV; or, identifying an animal having any symptom of an HBV infection including, but not limited to chronic HBV infection, inflammation, fibrosis, cirrhosis, liver cancer, serum hepatitis, jaundice, liver cancer, liver inflammation, liver fibrosis, liver cirrhosis, liver failure, diffuse hepatocellular inflammatory disease, hemophagocytic syndrome, serum hepatitis, HBV viremia, liver disease related to transplantation, and conditions having symptoms which may include any or all of the following: flu-like illness, weakness, aches, headache, fever, loss of appetite, diarrhea, nausea and vomiting, pain over the liver area of the body, clay- or grey-colored stool, itching all over, and dark-colored urine, when coupled with a positive test for presence of a hepatitis B virus, a hepatitis B viral antigen, or a positive test for the presence of an antibody specific for a hepatitis B viral antigen, when coupled with a positive test for presence of a hepatitis B virus, a hepatitis B viral antigen, or a positive test for the presence of an antibody specific for a hepatitis B viral antigen.

"Immediately adjacent" means there are no intervening elements between the immediately adjacent elements.

"Individual" means a human or non-human animal selected for treatment or therapy.

"Individual compliance" means adherence to a recommended or prescribed therapy by an individual.

"Induce", "inhibit", "potentiate", "elevate", "increase", "decrease" or the like, generally denote quantitative differences between two states. Such terms may refer to a statistically significant difference between the two states. For example, "an amount effective to inhibit the activity or expression of HBV" means that the level of activity or expression of HBV in a treated sample will quantitatively differ, and may be statistically significant, from the level of HBV activity or expression in untreated cells. Such terms are applied to, for example, levels of expression, and levels of activity. The term "inhibit" or "reduce" or grammatical variations thereof, as used herein, refer to a decrease or diminishment in the specified level or activity of at least about 5%, about 10%, about 15%, about 25%, about 35%, about 40%, about 50%, about 60%, about 75%, about 80%, about 90%, about 95% or more. In some embodiments, the inhibition or reduction results in little or essentially no detectible activity (at most, an insignificant amount, e.g., less than about 10% or even 5%).

"Inhibiting HBV" means reducing the level or expression of an HBV mRNA, DNA and/or protein. In certain embodiments, HBV is inhibited in the presence of an antisense compound targeting HBV, including an antisense oligonucleotide targeting HBV, as compared to expression of HBV mRNA, DNA and/or protein levels in the absence of a HBV antisense compound, such as an antisense oligonucleotide.

"Inhibiting the expression or activity" refers to a reduction, blockade of the expression or activity and does not necessarily indicate a total elimination of expression or activity.

"Injection site reaction" means inflammation or abnormal redness of skin at a site of injection in an individual.

"Internucleoside linkage" refers to the chemical bond between nucleosides.

"Intraperitoneal administration" means administration through infusion or injection into the peritoneum.

"Intravenous administration" means administration into a vein.

"Lengthened" antisense oligonucleotides are those that have one or more additional nucleosides relative to an antisense oligonucleotide disclosed herein.

"Linked deoxynucleoside" means a deoxyribonucleic acid base (A, G, C, T, U) linked by a phosphate ester to form a nucleotide.

"Linked nucleosides" means adjacent nucleosides linked together by an internucleoside linkage. An example of linked nucleoside is a linked nucleotide in which the linkage involves a phosphate group atom, e.g. a phosphodiester bond.

"Locked nucleic acid" or "LNA" or "LNA nucleosides" means nucleic acid monomers having a bridge connecting two carbon atoms between the 4' and 2' position of the nucleoside sugar unit, thereby forming a bicyclic sugar. Examples of such bicyclic sugar include, but are not limited to A) α-L-Methyleneoxy (4'-CH$_2$—O-2') LNA; (B) β-D-Methyleneoxy (4'-CH$_2$—O-2')-

(A)

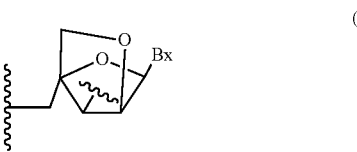

-continued (B)

(C)

(D)

(E)

LNA; (C) Ethyleneoxy (4'-(CH$_2$)$_2$—O-2') LNA; (D) Aminooxy (4'-CH$_2$—O—N(R)-2') LNA; and (E) Oxyamino (4'-CH$_2$—N(R)—O-2') LNA; as depicted below.

As used herein, LNA compounds include, but are not limited to, compounds having at least one bridge between the 4' and the 2' position of the sugar wherein each of the bridges independently comprises 1 or from 2 to 4 linked groups independently selected from —[C(R$^1$)(R$^2$)]$_n$—, —C(R$^1$)═C(R$^2$)—, —C(R$^1$)═N—, —C(═NR$^1$)—, —C(═O)—, —C(═S)—, —O—, —Si(R$^1$)$_2$—, —S(═O)$_x$— and —N(R$^1$)—; wherein: x is 0, 1, or 2; n is 1, 2, 3, or 4; each R$^1$ and R$^2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, a heterocycle radical, a substituted heterocycle radical, heteroaryl, substituted heteroaryl, C$_5$-C$_7$ alicyclic radical, substituted C$_5$-C$_7$ alicyclic radical, halogen, OJ$^1$, NJ$^1$J$^2$, SJ$^1$, N$_3$, COOJ$^1$, acyl (C(═O)—H), substituted acyl, CN, sulfonyl (S(═O)$_2$-J$^1$), or sulfoxyl (S(═O)-J$^1$); and each J$^1$ and J$^2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(═O)—H), substituted acyl, a heterocycle radical, a substituted heterocycle radical, C$_1$-C$_{12}$ aminoalkyl, substituted C$_1$-C$_{12}$ aminoalkyl or a protecting group.

Examples of 4'-2' bridging groups encompassed within the definition of LNA include, but are not limited to one of formulae: —[C(R$^1$)(R$^2$)]$_n$—, —[C(R$^1$)(R$^2$)]$_n$—O—, —C(R$^1$)(R$^2$)—N(R$^1$)—O— or —C(R$^1$)(R$^2$)—O—N(R$^1$)—. Furthermore, other bridging groups encompassed with the definition of LNA are 4'-CH$_2$-2', 4'—(CH$_2$)$_2$-2', 4'—(CH$_2$)$_3$-2', 4'—CH$_2$—O-2', 4'—(CH$_2$)$_2$—O-2', 4'—CH$_2$—O—N(R$^1$)-2' and 4'-CH$_2$—N(R$^1$)—O-2'-bridges, wherein each R$^1$ and R$^2$ is, independently, H, a protecting group or C$_1$-C$_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-CH$_2$—O-2') bridge to form the bicyclic sugar moiety. The bridge can also be a methylene (—CH$_2$—) group connecting the 2' oxygen atom and the 4' carbon atom, for which the term methyleneoxy (4'-CH$_2$—O-2') LNA is used. Furthermore, in the case of the bicyclic sugar moiety having an ethylene bridging group in this position, the term ethyleneoxy (4'-CH$_2$CH$_2$—O-2') LNA is used. α-L-methyleneoxy (4'-CH$_2$—O-2'), an isomer of methyleneoxy (4'-CH$_2$—O-2') LNA is also encompassed within the definition of LNA, as used herein.

A "maximum blood plasma concentration" or "C$_{max}$" refers to the highest concentration of a drug in the blood plasma after dose of the drug is given to a subject. Methods of measuring the concentration of drugs will be known to persons of ordinary skill in the art, and include, inter alia, liquid chromatography, and tandem mass spectrometry.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C) and uracil (U).

"Modified nucleoside" means a nucleoside having, independently, a modified sugar moiety and/or modified nucleobase.

"Modified nucleotide" means a nucleotide having, independently, a modified sugar moiety, modified internucleoside linkage, or modified nucleobase.

"Modified oligonucleotide" means an oligonucleotide comprising at least one modified internucleoside linkage, a modified sugar, and/or a modified nucleobase.

"Modified sugar" means substitution and/or any change from a natural sugar moiety.

"Monomer" refers to a single unit of an oligomer. Monomers include, but are not limited to, nucleosides and nucleotides, whether naturally occurring or modified.

"Motif" means the pattern of unmodified and modified nucleosides in an antisense compound. "Natural sugar moiety" means a sugar moiety found in DNA (2'-H) or RNA (2'-OH). "Naturally occurring internucleoside linkage" means a 3' to 5' phosphodiester linkage.

"Non-complementary nucleobase" refers to a pair of nucleobases that do not form hydrogen bonds with one another or otherwise support hybridization.

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

"Nucleobase sequence" means the order of contiguous nucleobases independent of any sugar, linkage, and/or nucleobase modification.

"Nucleoside" means a nucleobase linked to a sugar. A nucleoside includes deoxynucleosides, e.g. deoxyribonucleosides.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system. "Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleotide" means a nucleoside having a phosphate group covalently linked to the sugar portion of the nucleoside.

"Off-target effect" refers to an unwanted or deleterious biological effect associated with modulation of RNA or protein expression of a gene other than the intended target nucleic acid.

"Oligomeric compound" means a polymer of linked monomeric subunits which is capable of hybridizing to at least a region of a nucleic acid molecule.

"Oligonucleoside" means an oligonucleotide in which the internucleoside linkages do not contain a phosphorus atom.

"Oligonucleotide" means a polymer of linked nucleosides each of which can be modified or unmodified, independent one from another.

"Parenteral administration" means administration through injection (e.g., bolus injection) or infusion. Parenteral administration includes subcutaneous administration, intravenous administration, intramuscular administration, intraarterial administration, intraperitoneal administration, or intracranial administration, e.g., intrathecal or intracerebroventricular administration.

"Peptide" means a molecule formed by linking at least two amino acids by amide bonds. Without limitation, as used herein, "peptide" refers to polypeptides and proteins.

"Pharmaceutically acceptable carrier" means a medium or diluent that does not interfere with the structure of the oligonucleotide. Certain such carriers enable pharmaceutical compositions to be formulated as, for example, tablets, pills, dragees, capsules, liquids, gels, syrups, slurries, suspension and lozenges for the oral ingestion by a subject.

"Pharmaceutically acceptable derivative" encompasses pharmaceutically acceptable salts, conjugates, prodrugs or isomers of the compounds described herein.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Pharmaceutical agent" means a substance that provides a therapeutic benefit when administered to an individual. For example, in certain embodiments, an antisense oligonucleotide targeted to HBV is a pharmaceutical agent.

"Pharmaceutical composition" means a mixture of substances suitable for administering to a subject. For example, a pharmaceutical composition may comprise an antisense oligonucleotide and a sterile aqueous solution. In certain embodiments, a pharmaceutical composition shows activity in free uptake assay in certain cell lines.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevention" or "preventing" refers to delaying or forestalling the onset or development of a condition or disease for a period of time from hours to days, preferably weeks to months.

"Prodrug" means a therapeutic agent that is prepared in an inactive form that is converted to an active form (i.e., drug) within the body or cells thereof by the action of endogenous enzymes or other chemicals and/or conditions.

"Prophylactically effective amount" refers to an amount of a pharmaceutical agent that provides a prophylactic or preventative benefit to an animal.

"Recommended therapy" means a therapeutic regimen recommended by a medical professional for the treatment, amelioration, or prevention of a disease.

"Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"Salts" mean a physiologically and pharmaceutically acceptable salts of antisense compounds, i.e., salts that retain the desired biological activity of the parent oligonucleotide and do not impart undesired toxicological effects thereto.

"Segments" are defined as smaller or sub-portions of regions within a target nucleic acid.

A "separator" is a segment or region that separates two gap regions and is positioned in between two gap regions in a chimeric antisense compound. The separator segment may have one or more nucleosides, wherein the nucleosides are chemically distinct from the nucleosides comprising the gap.

A separator segment comprises nucleosides modified to impart properties such as enhanced inhibitory activity, increased binding affinity for a target nucleic acid, lowered in vivo toxicity or resistance to degradation by in vivo nucleases. A chimeric antisense compound may comprise one or more separator segments. A separator may be referred to as a "separator" a "separator region" or a "separator segment". Exemplary chimeric antisense compounds of the disclosure comprise one, two, three, four, five or six separator segments.

"Seroconversion" is defined as serum HBeAg absence plus serum HBeAb presence, if monitoring HBeAg as the determinant for seroconversion, or defined as serum HBsAg absence, if monitoring HBsAg as the determinant for seroconversion, as determined by currently available detection limits of commercial ELISA systems.

"Shortened" or "truncated" versions of antisense oligonucleotides taught herein have one, two or more nucleosides deleted.

"Side effects" means physiological responses attributable to a treatment other than desired effects. In certain embodiments, side effects include, without limitation, injection site reactions, liver function test abnormalities, renal function abnormalities, liver toxicity, renal toxicity, central nervous system abnormalities, and myopathies. For example, increased aminotransferase levels in serum may indicate liver toxicity or liver function abnormality. For example, increased bilirubin may indicate liver toxicity or liver function abnormality.

"Significant," as used herein means measurable or observable, e.g, a significant result, such as, a significant improvement or significant reduction generally refers to a measurable or observable result, such as a measurable or observable improvement or reduction.

"Sites," as used herein, are defined as unique nucleobase positions within a target nucleic acid.

"Slows progression" means decrease in the development of the said disease.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments. "Stringent hybridization conditions" or "stringent conditions" refer to conditions under which an oligomeric compound will hybridize to its target sequence, but to a minimal number of other sequences.

"Statistically Significant," as used herein means a measurable or observable parameter that is unlikely to occur by chance.

"Subcutaneous administration" means administration just below the skin. "Subject" means a human or non-human animal selected for treatment or therapy.

"Target" refers to a protein, the modulation of which is desired.

"Target gene" refers to a gene encoding a target.

"Targeting" means the process of design and selection of an antisense compound that will specifically hybridize to a target nucleic acid and induce a desired effect.

"Target nucleic acid," "target RNA," "target RNA transcript" and "nucleic acid target" all mean a nucleic acid capable of being targeted by antisense compounds.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Therapeutically effective amount" means an amount of a pharmaceutical agent that provides a therapeutic benefit to an individual.

"Treatment" refers to administering a composition to effect an alteration or improvement of the disease or condition.

"Unmodified" nucleobases mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. (3-D-ribonucleosides) or a DNA nucleotide (i.e. (3-D-deoxyribonucleoside).

"Validated target segment" is defined as at least an 8-nucleobase portion (i.e. 8 consecutive nucleobases) of a target region to which an active oligomeric compound is targeted.

A "wing" is a terminal segment of a chimeric antisense oligonucleotide, modified to impart to an oligonucleotide, properties such as enhanced inhibitory activity, increased binding affinity for a target nucleic acid, lowered in vivo toxicity or resistance to degradation by in vivo nucleases. A wing may be referred to as a "wing" a "wing region" or a "wing segment". As used herein, a wing comprises at least two linked nucleosides; a subset of which may comprise one or more deoxynucleosides, but the entire wing cannot be made up of only deoxynucleosides.

The chimeric antisense compounds of the disclosure comprise a 5' wing segment (W1) located at the 5' terminus of the chimeric antisense oligonucleotide and the residue at the 3' end of the W1 cannot be a deoxynucleoside. The chimeric antisense compounds of the disclosure also comprise a 3' wing segment (W2) located at the 3' terminus of the chimeric antisense oligonucleotide and the 5' terminal residue of the W2 cannot be a deoxynucleoside.

A 5' wing (W1) begins at the 5' terminus of the chimeric antisense oligonucleotide, extends in the 5' to 3' direction, and ends at the first nucleoside that is not a deoxynucleoside, that is directly linked to a deoxynucleoside of a first gap, thus indicating the 3' end of the W1 and the 5' end of a first gap (G1).

A 3' wing (W2) begins at the 3' terminus of the chimeric antisense oligonucleotide, extends in the 3' to 5' direction, and ends at the first nucleoside that is not a deoxynucleoside, that is directly linked to a deoxynucleoside of a gap, thus indicating the 3' end of the last gap of and the 5' end of the W2.

Exemplary Chimeric Antisense Oligonucleotides

The disclosure provides for at least the following exemplary chimeric antisense oligonucleotides.

In one aspect, provide is an oligonucleotide that is modified, the modified oligonucleotide comprising from 5' to 3':

$$5'\text{-}W1\text{-}G1\text{-}S1\text{-}G2\text{-}W2\ 3' \qquad \text{(Formula I)}$$

wherein:
W1 is a 5' wing segment;
W2 is a 3' wing segment;
G1 is a first gap segment;

S1 is a first separator segment;
G2 is a second gap segment;
- is an internucleoside linkage; and
at least one nucleoside of the oligonucleotide is modified.

In some embodiments, the modified oligonucleotide comprises from 5' to 3':

$$5'\text{-}W1\text{-}G1\text{-}S1\text{-}G2\text{-}S2\text{-}G3\text{-}W2\ 3' \qquad \text{(Formula II)}$$

wherein:
S2 is a second separator segment; and
G3 is a third gap segment.

In some embodiments, the modified oligonucleotide comprises from 5' to 3':

$$5'\text{-}W1\text{-}G1\text{-}S1\text{-}G2\text{-}S2\text{-}G3\text{-}S3\text{-}G4\text{-}W2\ 3' \qquad \text{(Formula III)}$$

wherein:
S3 is a third separator segment; and
G4 is a fourth gap segment.

In some embodiments, the modified oligonucleotide comprises from 5' to 3':

$$5'\text{-}W1\text{-}G1\text{-}S1\text{-}G2\text{-}S2\text{-}G3\text{-}S3\text{-}G4\text{-}S4\text{-}G5\text{-}W2\ 3' \qquad \text{(Formula IV)}$$

wherein:
S4 is a fourth separator segment; and
G5 is a fifth gap segment.

In some embodiments, the modified oligonucleotide comprises from 5' to 3':

$$5'\text{-}W1\text{-}G1\text{-}S1\text{-}G2\text{-}S2\text{-}G3\text{-}S3\text{-}G4\text{-}S4\text{-}G5\text{-}S5\text{-}G6\text{-}W2\ 3' \qquad \text{(Formula V)}$$

wherein:
S5 is a fifth separator segment; and
G6 is a sixth gap segment.

In some embodiments, the modified oligonucleotide comprises from 5' to 3':

$$5'\text{-}W1\text{-}G1\text{-}S1\text{-}G2\text{-}S2\text{-}G3\text{-}S3\text{-}G4\text{-}S4\text{-}G5\text{-}S5\text{-}G6\text{-}S6\text{-}G7\text{-}W2\ 3' \qquad \text{(Formula VI)}$$

wherein:
S6 is a sixth separator segment; and
G7 is a seventh gap segment.

In some embodiments, W1 comprises 2 to 25 linked nucleosides. In some embodiments, W1 comprises one or more linked deoxynucleosides.

In some embodiments, W2 comprises 2 to 35 linked nucleosides. In some embodiments, W2 comprises one or more linked deoxynucleosides.

In some embodiments, any one or more of G1, G2, G3, G4, G5, G6, and/or G7 comprises 1 to 10 linked deoxynucleosides.

In some embodiments, any one or more of S1, S2, S3, S4, S5, and/or S6 comprise 1, 2, 3, 4, or 5 linked nucleosides.

In some embodiments, the modified oligonucleotide is 18-50 nucleobases in length. In some embodiments, the modified oligonucleotide is at least 20 nucleobases in length. In some embodiments, the modified oligonucleotide is 20 nucleobases in length.

In some embodiments, the modified oligonucleotide is of Formula I, and W1 comprises 4-6 linked nucleosides, G1 comprises 1-6 linked deoxynucleosides, S1 comprises 1 linked nucleoside, G2 comprises 1-6 linked deoxynucleosides, and W2 comprises 4-6 linked nucleosides.

In some embodiments, the modified oligonucleotide is of Formula I, and W1 comprises 4-6 linked nucleosides, G1 comprises 5 linked deoxynucleosides, S1 comprises 1 linked nucleoside, G2 comprises 5 linked deoxynucleosides, and W2 comprises 4-6 linked nucleosides.

In some embodiments, the modified oligonucleotide is of Formula I, and W1 comprises 4 linked nucleosides, G1 comprises 5 linked deoxynucleosides, S1 comprises 1 linked nucleoside, G2 comprises 5 linked deoxynucleosides, and W2 comprises 5 linked nucleosides.

In some embodiments, the modified oligonucleotide is of Formula I, and the length of the G1-S1-G2 is between 8 and 12 nucleobases in length.

The following embodiments pertain to any of Formula I-VI: In some embodiments, G1, G2, G3, G4, G5, G6, and G7 can comprise a nucleoside comprising a modification to a 2'-deoxynucleoside. In some embodiments, any one or more of G1, G2, G3, G4, G5, G6, and G7 comprises a nucleoside comprising a 2'-deoxy 5-methylcytidine sugar modification. In some embodiments, S1, S2, S3, S4, S5, and/or S6 comprises a nucleoside comprising a 2'-O-methoxyethyl sugar modification. In some embodiments, S1, S2, S3, S4, S5, and/or S6 comprises a nucleoside comprising a 5-methylcytidine. In some embodiments, S1, S2, S3, S4, S5, and/or S6 comprises a nucleoside comprising a 2'-O-methyl sugar modification. In some embodiments, S1, S2, S3, S4, S5, and/or S6 comprises a nucleoside comprising a 2'-OH sugar modification. In some embodiments, S1, S2, S3, S4, S5, and/or S6 comprises a nucleoside comprising a 2'-fluoro sugar modification. In some embodiments, S1, S2, S3, S4, S5, and/or S6 comprises a nucleoside comprising a 2'-fluoro-arabinonucleic acid (2'-fluoro-ANA) sugar modification. In some embodiments, S1, S2, S3, S4, S5, and/or S6 comprises a glycol nucleic acid (GNA). In some embodiments, S1, S2, S3, S4, S5, and/or S6 comprises a LNA. In some embodiments, W1 comprises a nucleoside comprising a 2'-deoxy sugar modification (e.g, wherein the 2'-deoxy sugar modification is at positions 2 and/or 5 of a sequence corresponding to SEQ ID NO: 2.). In some embodiments, W1 comprises a nucleoside comprising a 2'-O-methoxyethyl sugar modification (e.g wherein the 2'-O-methoxyethyl sugar modification is at position 1, 2, 3, 4 and/or 5 of a sequence corresponding to SEQ ID NO: 2). In some embodiments, W1 comprises a 2'-O-methoxyethyl 5-methylcytidine at position 2 of a sequence corresponding to SEQ ID NO: 2. In some embodiments, W1 comprises a nucleoside comprising a 2'-O-methyl sugar modification (e.g, wherein the 2'-O-methyl sugar modification is at positions 1, 2, 3, 4 and/or 5 of a sequence corresponding to SEQ ID NO: 2). In some embodiments, W1 comprises a 2'-O-methyl 5-methylcytidine at position 2 of a sequence corresponding to SEQ ID NO: 2. In some embodiments, W1 comprises a nucleoside comprising a 2'-fluoro sugar modification. In some embodiments, W1 comprises a nucleoside comprising a 2'-fluoro-arabinonucleic acid (2'-fluoro-ANA) modification. In some embodiments, W1 comprises a glycol nucleic acid (GNA) (e.g, wherein the GNA is at position 2 of a sequence corresponding to SEQ ID NO: 2.) In some embodiments, W1 comprises a modified nucleoside and wherein the modified nucleoside is a locked nucleic acid (LNA) (e.g, wherein the LNA is at positions 1 and/or 3 of a sequence corresponding to SEQ ID NO: 2). In some embodiments, W2 comprises a nucleoside comprising a 2'-deoxy sugar modification (e.g, wherein the 2'-deoxy sugar modification is at positions 15 and/or 16 of a sequence corresponding to SEQ ID NO: 2). In some embodiments, W2 comprises a nucleoside comprising a 2'-O-methoxyethyl sugar modification (e.g, wherein the 2'-O-methoxyethyl sugar modification is at positions 15, 16, 17, 18, 19 and/or 20 of a sequence corresponding to SEQ ID NO: 2). In some embodiments, W2 comprises a nucleoside comprising a 2'-O-methyl sugar modification (e.g, wherein the 2'-O-methyl sugar modification is at positions 15, 16, 17, 18, 19 and/or 20 of a sequence corresponding to SEQ ID NO: 2. In some embodiments, W2 comprises a nucleoside comprising a 2'-fluoro sugar modification. In some embodiments, W2 comprises a nucleoside comprising a 2'-fluoro-arabino-nucleic acid (2'-fluoro-ANA) modification. In some embodiments, W2 comprises a modified nucleoside and wherein the modified nucleoside is a glycol nucleic acid (GNA). In some embodiments, W2 comprises a modified nucleoside and wherein the modified nucleoside is a locked nucleic acid (LNA) (e.g, wherein the LNA is at positions 16, 17, 18, 19 and/or 20 of a sequence corresponding to SEQ ID NO: 2.)
Exemplary Target Sequences and Exemplary Modified Oligonucleotides Certain embodiments provide methods, compounds, and compositions for inhibiting HBV mRNA expression.

Certain embodiments provide antisense compounds targeted to a HBV nucleic acid sequence. Exemplary HBV nucleic acid sequences include but are not limited to those shown in Table 1.

TABLE 1

| Exemplary HBV sequences | | |
| --- | --- | --- |
| HBV Genotype | Accession No. | SEQ ID NO: |
| GTD (HepG2.2.15 cells) | U95551.1 | SEQ ID NO: 3 |
| GTA | AJ309369.1 | SEQ ID NO: 667 |
| GTB | D00330.1 | SEQ ID NO: 668 |
| GTC | AB033550.1 | SEQ ID NO: 669 |
| GTD | KX470733.1 | SEQ ID NO: 670 |
| GTE | KX186584 | SEQ ID NO: 671 |
| GTF | KP718112 | SEQ ID NO: 672 |
| GTG | KX264500 | SEQ ID NO: 673 |
| GTH | KX264501 | SEQ ID NO: 674 |

In certain embodiments, the HBV nucleic acid is the sequence set forth in GENBANK Accession No. U95551.1 (incorporated herein as SEQ ID NO: 3). In some embodiments, the antisense compounds target a sequence recited in SEQ ID NO: 3 or a portion thereof. In some embodiments, the antisense compounds target a sequence at positions 1583-1602 of SEQ ID NO: 3.

Exemplary HBV nucleic acid target sequences include but are not limited to those shown in Table 2.

TABLE 2

| Exemplary HBV Target Sequences | |
| --- | --- |
| HBV Target Sequence | SEQ ID NO: |
| CTTGG TCATG GGCCA TCAG | 1 |
| GCACT TCGCT TCACC TCTGC | 4 |
| TTTGTTTACGTCCCGTCGGC | 675 |
| TTTACGTCCCGTCGGCGCTGAATCCTGCGG | 676 |
| TTTACGTCCCGTCGGCGCTG | 677 |
| TTTACGCGGACTCCCCGTCT | 678 |
| TTGTTTACGTCCCGTCGGCG | 679 |
| TTGTTGACAAGAATCCTCAC | 680 |
| TTGAGAGAAGTCCACCACG | 681 |
| TTCTCCTGGCTCAGTTTACTAGTGCCATTT | 682 |
| TTCTCCTGGCTCAGTTTACT | 683 |
| TTACGTCCCGTCGGCGCTGA | 684 |

TABLE 2-continued

Exemplary HBV Target Sequences

| HBV Target Sequence | SEQ ID NO: |
|---|---|
| TGTTTACGTCCCGTCGGCGC | 685 |
| TGTGCCTTCTCATCTGCCGG | 686 |
| TGTGCACTTCGCTTCACCTC | 687 |
| TGGTGGACTTCTCTCAATTT | 688 |
| TGGCTCAGTTTACTAGTGCC | 689 |
| TGGACTTCTCTCAATTTTCTAGGGG | 690 |
| TGGACTTCTCTCAATTTTCT | 691 |
| TGCCTTCTCATCTGCCGGAC | 692 |
| TGCCGGACCGTGTGCACTTC | 693 |
| TGCCGATCCATACTGCGGAA | 694 |
| TGCACTTCGCTTCACCTCTG | 695 |
| TGACAAGAATCCTCACAATA | 696 |
| TCTTTACGCGGACTCCCCGT | 697 |
| TCTTGTTGACAAGAATCCTC | 698 |
| TCTGTGCCTTCTCATCTGCC | 699 |
| TCTGCCGATCCATACTGCGG | 700 |
| TCTCTTTACGCGGACTCCCC | 701 |
| TCTCATCTGCCGGACCGTGT | 702 |
| TCGGCGCTGAATCCTGCGGA | 703 |
| TCCTGGCTCAGTTTACTAGT | 704 |
| TCCTCACAATACCGCAGAGT | 705 |
| TCCCGTCGGCGCTGAATCCT | 706 |
| TCCATACTGCGGAACTCCTA | 707 |
| TCATCTGCCGGACCGTGTGC | 708 |
| TCATCTCGAACGTTCACAGTCA | 709 |
| TCAGTTTACTAGTGCCATTT | 710 |
| TATTGTGAGGATTCTTGTCA | 711 |
| TAGGAGGCTGTAGGCATAAATTGGTCTGCG | 712 |
| TACGTCCCGTCGGCGCTGAA | 713 |
| TACGCGGACTCCCCGTCTGT | 714 |
| GTTTACGTCCCGTCGGCGCT | 715 |
| GTTGGTGCACTTCGCTTCAC | 716 |
| GTTGACAAGAATCCTCACAA | 717 |
| GTTCCCAGTATGGATCGGC | 718 |
| GTGTGCACTTCGCTTCACCT | 719 |
| GTGGTGGACTTCTCTCAATT | 720 |
| GTGGACTTCTCTCAATTTTCT | 721 |
| GTGGACTTCTCTCAATTTTC | 722 |

TABLE 2-continued

Exemplary HBV Target Sequences

| HBV Target Sequence | SEQ ID NO: |
|---|---|
| GTGCCTTCTCATCTGCCGGA | 723 |
| GTGCACTTCGCTTCACCTCT | 724 |
| GTGAAGCGAAGTGCACACGG | 725 |
| GTCTGTGCCTTCTCATCTGC | 726 |
| GTCGGCGCTGAATCCTGCGG | 727 |
| GTCCCGTCGGCGCTGAATCC | 728 |
| GTATTGTGAGGATTCTTGTC | 729 |
| GGTGGACTTCTCTCAATTTT | 730 |
| GGGCGCACCTCTCTTTACGC | 731 |
| GGCTGTAGGCATAAATTGGT | 732 |
| GGCGCTGAATCCTGCGGACG | 733 |
| GGAGGAACCTTCAGGGAAGG | 734 |
| GGACTCCCCGTCTGTGCCTT | 735 |
| GGACCGTGTGCACTTCGCTT | 736 |
| GCTGTAGGCATAAATTGGT | 737 |
| GCTGAATCCTGCGGACGACC | 738 |
| GCTCAGTTTACTAGTGCCAT | 739 |
| GCGGACTCCCCGTCTGTGCC | 740 |
| GCGCTGAATCCTGCGGACGA | 741 |
| GCGCACCTCTCTTTACGCGG | 742 |
| GCCTTCTCATCTGCCGGACC | 743 |
| GCCGGACCGTGTGCACTTCG | 744 |
| GCCGATCCATACTGCGGAAC | 745 |
| GCCGATCCATACTGCGGAA | 746 |
| GCACTTCGCTTCACCTCTGC | 747 |
| GCACTAGTAAACTGAGCCAG | 748 |
| GCACCTCTCTTTACGCGGAC | 749 |
| GATCCATACTGCGGAACTCC | 750 |
| GACTCCCCGTCTGTGCCTTC | 751 |
| GACCGTGTGCACTTCGCTTC | 752 |
| GACAAGAATCCTCACAATAC | 753 |
| GAATCCTCACAATACCGCAG | 754 |
| GAAAATTGAGAGAAGTCCAC | 755 |
| CTTTGTTTACGTCCCGTCGG | 756 |
| CTTGTTGACAAGAATCCTCACAATACCGCA | 757 |
| CTTCTCATCTGCCGGACCGT | 758 |
| CTGTGCCTTCTCATCTGCCG | 759 |
| CTGGCTCAGTTTACTAGTGC | 760 |

TABLE 2-continued

Exemplary HBV Target Sequences

| HBV Target Sequence | SEQ ID NO: |
|---|---|
| CTGGCTCAGTTTACTAGTG | 761 |
| CTGCCGGACCGTGTGCACTT | 762 |
| CTGCCGATCCATACTGCGGA | 763 |
| CTCTGCCGATCCATACTGCG | 764 |
| CTCCTGGCTCAGTTTACTAG | 765 |
| CTCCCCGTCTGTGCCTTCTC | 766 |
| CTCACAATACCGCAGAGTCT | 767 |
| CTATCAAGGTATGTTGCCCGTTTGTCCTCT | 768 |
| CGTGTGCACTTCGCTTCACC | 769 |
| CGTGGTGGACTTCTCTCAATTTTCTAGGGG | 770 |
| CGTGGTGGACTTCTCTCAATTTTCT | 771 |
| CGTGGTGGACTTCTCTCAAT | 772 |
| CGTGGTGGACTTCTCTCAAT | 773 |
| CGTCGGCGCTGAATCCTGCG | 774 |
| CGTCCCGTCGGCGCTGAATC | 775 |
| CGGGGCGCACCTCTCTTTAC | 776 |
| CGGCGCTGAATCCTGCGGAC | 777 |
| CGGACTCCCCGTCTGTGCCT | 778 |
| CGGACCGTGTGCACTTCGCT | 779 |
| CGCTGAATCCTGCGGACGAC | 780 |
| CGCGGACTCCCCGTCTGTGC | 781 |
| CGCACCTCTCTTTACGCGGA | 782 |
| CCTTTGTTTACGTCCCGTCG | 783 |
| CCTTCTCATCTGCCGGACCG | 784 |
| CCTTAGGCACTCCTGCCTCT | 785 |
| CCTGGCTCAGTTTACTAGTG | 786 |
| CCTCTGCCGATCCATACTGCGGAACTCCTA | 787 |
| CCTCTGCCGATCCATACTGC | 788 |
| CCTCTCTTTACGCGGACTCC | 789 |
| CCTCACAATACCGCAGAGTC | 790 |
| CCGTGTGCACTTCGCTTCAC | 791 |
| CCGTGTGCACTTCGCTGTTG | 792 |
| CCGTGTGCACTTCGCT | 793 |
| CCGTCTGTGCCTTCTCATCT | 794 |
| CCGTCGGCGCTGAATCCTGC | 795 |
| CCGGTCCGTGTGCACTTCGC | 796 |
| CCGGACCGTGTGCACTTCGC | 797 |
| CCGATCCATACTGCGGAACT | 798 |

TABLE 2-continued

Exemplary HBV Target Sequences

| HBV Target Sequence | SEQ ID NO: |
|---|---|
| CCCGTCGGCGCTGAATCCTG | 799 |
| CCCCGTCTGTGCCTTCTCAT | 800 |
| CAGGTCCCCTAGAAGAAGAA | 801 |
| CACGGGGCGCACCTCTCTTT | 802 |
| CACCTCTCTTTACGCGGACT | 803 |
| CAAGAATCCTCACAATACCG | 804 |
| ATCTGCCGGACCGTGTGCAC | 805 |
| ATCCTCACAATACCGCAGAG | 806 |
| AGACTCGTGGTGGACTTCTCTCAATTTTCT | 807 |
| AGAATCCTCACAATACCGCA | 808 |
| ACGTCCCGTCGGCGCTGAAT | 809 |
| ACGCGGACTCCCCGTCTGTG | 810 |
| ACCTCTCTTTACGCGGACTC | 811 |
| ACCGTGTGCACTTCGCTTCA | 812 |
| ACCAATTTATGCCTACAGCG | 813 |
| ACAAGAATCCTCACAATACC | 814 |
| AATCCTCACAATACCGCAGA | 815 |
| AAGGTATGTTGCCCGTTTGT | 816 |
| AAGAATCCTCACAATACCGC | 817 |
| CTAGACTCGTGGTGGACTTC | 819 |
| CCTGCTGCTATGCCTCATCT | 820 |
| CTGCTGCTATGCCTCATCTT | 821 |
| TGCTGCTATGCCTCATCTTC | 822 |
| GCTGCTATGCCTCATCTTCT | 823 |
| CTGCTATGCCTCATCTTCTT | 824 |
| CCTATGGGAGTGGGCCTCAG | 825 |
| GCCATTTGTTCAGTGGTTCG | 826 |
| GGAGGCTGTAGGCATAAATT | 827 |
| GAGGCTGTAGGCATAAATTG | 828 |
| AGGCTGTAGGCATAAATTGG | 829 |
| GGCTGTAGGCATAAATTGGT | 830 |
| TTCAAGCCTCCAAGCTGTGC | 831 |
| TCAAGCCTCCAAGCTGTGCC | 832 |
| CAAGCCTCCAAGCTGTGCCT | 833 |
| AAGCCTCCAAGCTGTGCCTT | 834 |
| AGCCTCCAAGCTGTGCCTTG | 835 |

TABLE 2-continued

Exemplary HBV Target Sequences

| HBV Target Sequence | SEQ ID NO: |
|---|---|
| GCCTCCAAGCTGTGCCTTGG | 836 |
| GAACTCCCTCGCCTCGCAGA | 837 |
| CACCATATTCTTGGGAACA | 838 |

In some embodiments, the HBV target comprises a sequence of SEQ ID NO: 1, 4, 675-838. In some embodiments, the HBV target comprises a sequence of CTTGG TCATG GGCCA TCAG (SEQ ID NO: 1). In some embodiments, the HBV target comprises a sequence of (SEQ ID NO: 4)
GCACT TCGCT TCACC TCTGC.

In certain embodiments, the compounds provided herein comprise a modified oligonucleotide. In certain embodiments the compounds comprise a modified oligonucleotide and a conjugate as described herein. In certain embodiments, the modified oligonucleotide is a pharmaceutically acceptable derivative.

In certain embodiments, the HBV target comprises the sequence recited in SEQ ID NO: 3 or a portion thereof or a variant thereof. In certain embodiments, the modified oligonucleotide is at least 75%, or at least 80%, or at least 85%, or at least 90%, or at least 95%, or 100% complementary to a HBV nucleic acid.

In certain embodiments, the HBV target comprises the sequence recited in SEQ ID NO: 1. In certain embodiments, the modified oligonucleotide is at least 75%, or at least 80%, or at least 85%, or at least 90%, or at least 95%, or 100% complementary to SEQ ID NO: 1.

In certain embodiments, the HBV target comprises the sequence recited in SEQ ID NO: 4. In certain embodiments, the modified oligonucleotide is at least 75%, or at least 80%, or at least 85%, or at least 90%, or at least 95%, or 100% complementary to SEQ ID NO: 4.

In some embodiments, the compounds or compositions comprise a modified oligonucleotide of 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 linked nucleosides in length that bind to a HBV target sequence. In certain embodiments, the compounds or compositions comprise a modified oligonucleotide of 20 linked nucleosides that bind to a HBV target sequence.

In certain embodiments, the modified oligonucleotide of 20 linked nucleosides has a nucleobase sequence of GCAGA GGTGA AGCGA AGTGC (SEQ ID NO: 2). A chart showing the nucleobase positions of SEQ ID NO: 2 is shown below:

| 1 | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|
| G | C | A | G | A | G | G | T | G | A | A | G | C | G | A | A | G | T | G | C |

In certain embodiments, the modified oligonucleotide of 20 linked nucleosides has a nucleobase sequence of GTGAA GCGAA GTGCA CACGG (SEQ ID NO: 5). A chart showing the nucleobase positions of SEQ ID NO: 5 is shown below:

| 1 | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|
| G | T | G | A | A | G | C | G | A | A | G | T | G | C | A | C | A | C | G | G |

In certain embodiments, the compound comprises a modified oligonucleotide described herein. Exemplary modified oligonucleotides include but are not limited to those shown in FIGS. 1-2. In some embodiments, the compound comprises a modified oligonucleotide comprising the sequence of any one of AUS1010 to AUS1714. In some embodiments, the compound comprises a modified oligonucleotide comprising the sequence of any one of SEQ ID NOS: 11 to 666, or a modified oligonucleotide comprising 1, 2, 3, 4, or 5 modifications thereto.

In certain embodiments, the compound comprises a modified oligonucleotide comprising the sequence of any one of A, B, C, D, E, F, G, H, I, J, K, L, M, N, O, P, Q, R, S, T, U, V, W, X, Y, Z, AA, AB, AC, AD, AE, AF, AG, AH, AI, AJ, AK, AL, AM, AN, AO, AP, AQ, AR, AS, AT, AU, AV, AW or AX. Table 3 shows a correspondence table for the alphabet identifier, the AUS identifier and the SEQ ID NO corresponding to the sequence of the modified oligonucleotide.

TABLE 3

Nomenclature Correspondence Table for Modified Oligonucleotides

| Alphabet Identifier | AUS Identifier | SEQ ID NO: |
|---|---|---|
| A | AUS1427/AUS1461 | 390/424 |
| B | AUS1422 | 385 |
| C | AUS1423 | 386 |
| D | AUS1424 | 387 |
| E | AUS1425 | 388 |
| F | AUS1426 | 389 |
| G | AUS1428 | 391 |
| H | AUS1458 | 421 |
| I | AUS1459 | 422 |
| J | AUS1460 | 423 |
| K | AUS1322 | 294 |
| L | AUS1326 | 298 |
| M | AUS1439 | 402 |
| N | AUS1443 | 406 |
| O | AUS1444 | 407 |
| P | AUS1462 | 425 |
| Q | AUS1499 | 462 |
| R | AUS1500 | 463 |
| S | AUS1465 | 428 |
| T | AUS1469 | 432 |
| U | AUS1475 | 438 |
| V | AUS1473 | 436 |
| W | AUS1472 | 435 |
| X | AUS1474 | 437 |
| Y | AUS1478 | 441 |
| Z | AUS1479 | 442 |
| AA | AUS1494 | 457 |
| AB | AUS1463 | 426 |
| AC | AUS1468 | 431 |
| AD | AUS1466/AUS1495 | 429/458 |
| AE | AUS1429 | 392 |
| AF | AUS1431 | 394 |
| AG | AUS1436 | 399 |
| AH | AUS1437 | 400 |
| AI | AUS1441 | 404 |
| AJ | AUS1464 | 427 |
| AK | AUS1467 | 430 |
| AL | AUS1470 | 433 |
| AM | AUS1471 | 434 |
| AN | AUS1477 | 440 |
| AO | AUS1476/AUS1493 | 439/456 |
| AP | AUS1430 | 393 |
| AQ | AUS1432 | 395 |
| AR | AUS1440 | 403 |
| AS | AUS1438 | 401 |
| AT | AUS1489 | 452 |

TABLE 3-continued

Nomenclature Correspondence Table for Modified Oligonucleotides

| Alphabet Identifier | AUS Identifier | SEQ ID NO: |
|---|---|---|
| AU | AUS1488/AUS1497 | 451/460 |
| AV | AUS1490 | 453 |
| AW | AUS1498 | 461 |
| AX | AUS1433 | 396 |

Features of Modified Oligonucleotides

In certain embodiments, the compound comprises a modified oligonucleotide of 20 linked nucleosides consisting of: a first gap segment consisting of linked nucleosides; a second gap segment consisting of linked nucleosides; a separator segment consisting of a nucleoside linked to the first gap segment and the second gap segment; a 5' wing segment consisting of linked nucleosides; and a 3' wing segment consisting of linked nucleosides; wherein the first gap segment, separator segment, and second gap segment are positioned between the 5' wing segment and the 3' wing segment; wherein the first gap segment is attached to the 5' wing segment, and the second gap segment is attached to the 3' wing segment, wherein the first gap segment, separator segment, and second gap segment, taken together, consist of 8 or 9 or 10 or 11 or 12 linked nucleosides.

In certain embodiments, the compound comprises a modified oligonucleotide of 20 linked nucleosides consisting of: a first gap segment consisting of linked nucleosides; a second gap segment consisting of linked nucleosides; a separator segment consisting of a nucleoside linked between the first gap segment and the second gap segment; wherein the first gap segment, the separator segment, and the second gap segment, taken together, consist of 8 or 9 or 10 or 11 or 12 nucleotides; a 5' wing segment consisting of linked nucleosides; and a 3' wing segment consisting of linked nucleosides; wherein the first gap segment, second gap segment, and separator segment are positioned between the 5' wing segment and the 3' wing segment; wherein the first gap segment is attached to the 5' wing segment, and the second gap segment is attached to the 3' wing segment; wherein the first gap segment consists of linked nucleosides with 2'-deoxy sugars; wherein the second gap segment consists of linked nucleosides with 2'-deoxy sugars; wherein the separator segment consists of one nucleoside comprising a 2'-O(CH$_2$)$_2$—OCH$_3$ sugar or a 2'—OCH$_3$ sugar, wherein the modified oligonucleotide is at least 95% complementary to SEQ ID NO: 1; and wherein said modified oligonucleotide has a nucleobase sequence of SEQ ID NO: 2 (GCAGA GGTGA AGCGA AGTGC).

In certain embodiments, the compound comprises a modified oligonucleotide of 20 linked nucleosides consisting of: a first gap segment consisting of linked nucleosides; a second gap segment consisting of linked nucleosides; a separator segment consisting of a nucleoside linked between the first gap segment and the second gap segment; wherein the first gap segment, the separator segment, and the second gap segment, taken together, consist of 8 or 9 or 10 or 11 or 12 nucleotides; a 5' wing segment consisting of linked nucleosides; and a 3' wing segment consisting of linked nucleosides; wherein the first gap segment, second gap segment, and separator segment are positioned between the 5' wing segment and the 3' wing segment; wherein the first gap segment is attached to the 5' wing segment, and the second gap segment is attached to the 3' wing segment; wherein the first gap segment consists of linked nucleosides with 2'-deoxy sugars; wherein the second gap segment consists of linked nucleosides with 2'-deoxy sugars; wherein the separator segment consists of one nucleoside comprising a 2'-O(CH$_2$)$_2$—OCH$_3$ sugar or a 2'—OCH$_3$ sugar, wherein at least one of the nucleosides in the 5' wing segment comprises a 2'-O(CH$_2$)$_2$—OCH$_3$ sugar; and wherein at least one of the nucleosides in the 3' wing segment comprises a 2'-O(CH$_2$)$_2$—OCH$_3$ sugar; wherein the modified oligonucleotide is at least 95% complementary to SEQ ID NO: 1; and wherein said modified oligonucleotide has a nucleobase sequence of SEQ ID NO: 2 (GCAGA GGTGA AGCGA AGTGC).

A. 5' Wing Segment, General

In certain embodiments, at least one of the nucleosides in the 5' wing segment comprises a 2'-O(CH$_2$)$_2$—OCH$_3$ sugar. In certain embodiments, each of the nucleosides in the 5' wing segment comprises a 2'-O(CH$_2$)$_2$—OCH$_3$ sugar. In certain embodiments, the 5' wing segment comprises a nucleoside with a 2'-deoxy sugar. In certain embodiments, the 5' wing segment comprises a nucleoside with a 2'-deoxy sugar, and the other nucleosides in the 5' wing segment comprise a 2'-O(CH$_2$)$_2$—OCH$_3$ sugar. In certain embodiments, the nucleoside at position 2 of SEQ ID NO: 2 comprises a 2'-deoxy sugar. In certain embodiments, the nucleoside at position 3 of SEQ ID NO: 2 comprises a 2'-deoxy sugar. In certain embodiments, the nucleoside at position 4 of SEQ ID NO: 2 comprises a 2'-deoxy sugar. In certain embodiments, the 5' wing segment further comprises two nucleosides each with a 2'-deoxy sugar. In certain embodiments, the nucleosides at positions 2 and 3 of SEQ ID NO: 2 comprise a 2'-deoxy sugar. In certain embodiments, the nucleosides at positions 2 and 4 of SEQ ID NO: 2 comprise a 2'-deoxy sugar. In certain embodiments, the nucleosides at positions 3 and 4 of SEQ ID NO: 2 comprise a 2'-deoxy sugar. In certain embodiments, the nucleosides at positions 2 and 5 of SEQ ID NO: 2 comprise a 2'-deoxy sugar.

In certain embodiments, one, two, three, or four of the nucleosides in the 5' wing segment comprise a sugar modification described herein. In certain embodiments, one, two, three, or four of the nucleosides in the 5' wing segment comprise a bicyclic sugar. In certain embodiments, one, two, three, or four of the nucleosides in the 5' wing segment comprise a constrained ethyl sugar.

In certain embodiments, one, two, three, or four of the nucleosides in the 5' wing segment comprise a locked nucleic acid. In certain embodiments, one, two, three, or four of the nucleosides in the 5' wing segment comprise a 4'-CH$_2$—O-2' sugar. In certain embodiments, two of the nucleosides in the 5' wing segment comprise a locked nucleic acid. In certain embodiments, two of the nucleosides in the 5' wing segment comprise a 4'-CH$_2$—O-2' sugar. In certain embodiments, the nucleosides at positions 1 and 3 of SEQ ID NO: 2 comprise a locked nucleic acid. In certain embodiments, the nucleosides at positions 1 and 3 of SEQ ID NO: 2 comprise a 4'-CH$_2$—O-2' sugar.

B1. 5' Wing Segment w/4 Linked Nucleosides

In certain embodiments, the 5' wing segment consists of 4 linked nucleosides. In certain embodiments, the 5' wing segment consists of 4 linked nucleosides, wherein each of the 4 linked nucleosides comprise a nucleoside with a 2'-O(CH$_2$)$_2$—OCH$_3$ sugar. In certain embodiments, the 5' wing segment consists of 4 linked nucleosides, wherein 3 of the 4 linked nucleosides comprise a nucleoside with a 2'-O(CH$_2$)$_2$—OCH$_3$ sugar. In certain embodiments, the 5' wing segment consists of 4 linked nucleosides, wherein 2 of the 4 linked nucleosides comprise a nucleoside with a 2'-O(CH$_2$)$_2$—OCH$_3$ sugar. In certain embodiments, the 5' wing segment consists of 4 linked nucleosides, wherein 1 of the 4 linked nucleosides comprises a nucleoside with a 2'-O(CH$_2$)$_2$—OCH$_3$ sugar.

B2. 5' Wing Segment w/4 Linked Nucleosides, 2'-Deoxy Combinations

In certain embodiments, the 5' wing segment consists of 4 linked nucleosides, wherein one of the linked nucleosides comprises a nucleoside with a 2'-deoxy sugar. In certain embodiments, the 5' wing segment consists of 4 linked nucleosides, wherein two of the linked nucleosides comprises a nucleoside with a 2'-deoxy sugar. In certain embodiments, the 5' wing segment consists of 4 linked nucleosides, wherein one of the 4 linked nucleosides comprises a nucleoside with a 2'-deoxy sugar, and each of the other 3 linked nucleosides comprise a nucleoside with a 2'-O(CH$_2$)$_2$—OCH$_3$ sugar. In certain embodiments, the 5' wing segment consists of 4 linked nucleosides, wherein one of the 4 linked nucleosides comprises a nucleoside with a 2'-deoxy sugar, one of the 4 linked nucleosides comprises a locked nucleic acid, and each of the other 2 linked nucleosides comprise a nucleoside with a 2'-O(CH$_2$)$_2$—OCH$_3$ sugar. In certain embodiments, the 5' wing segment consists of 4 linked nucleosides, wherein one of the 4 linked nucleosides comprises a nucleoside with a 2'-deoxy sugar, two of the 4 linked nucleosides comprise a locked nucleic acid, and the other linked nucleoside comprises a nucleoside with a 2'-O(CH$_2$)$_2$—OCH$_3$ sugar.

In certain embodiments, the 5' wing segment consists of 4 linked nucleosides, wherein the nucleoside at position 2 of SEQ ID NO: 2 comprises a 2'-deoxy sugar. In certain embodiments, the 5' wing segment consists of 4 linked nucleosides, wherein the nucleoside at position 2 of SEQ ID NO: 2 comprises a 2'-deoxy sugar, and each of the other 3 linked nucleosides comprise a nucleoside with a 2'-O(CH$_2$)$_2$—OCH$_3$ sugar. In certain embodiments, the 5' wing segment consists of 4 linked nucleosides, wherein the nucleoside at position 3 of SEQ ID NO: 2 comprises a 2'-deoxy sugar. In certain embodiments, the 5' wing segment consists of 4 linked nucleosides, wherein the nucleoside at position 3 of SEQ ID NO: 2 comprises a 2'-deoxy sugar, and each of the other 3 linked nucleosides comprise a nucleoside with a 2'-O(CH$_2$)$_2$—OCH$_3$ sugar. In certain embodiments, the 5' wing segment consists of 4 linked nucleosides, wherein the nucleoside at position 4 of SEQ ID NO: 2 comprises a 2'-deoxy sugar. In certain embodiments, the 5' wing segment consists of 4 linked nucleosides, wherein the nucleoside at position 4 of SEQ ID NO: 2 comprises a 2'-deoxy sugar, and each of the other 3 linked nucleosides comprise a nucleoside with a 2'-O(CH$_2$)$_2$—OCH$_3$ sugar.

In certain embodiments, the 5' wing segment consists of 4 linked nucleosides, wherein the nucleosides at positions 2 and 3 of SEQ ID NO: 2 comprise a 2'-deoxy sugar. In certain embodiments, the 5' wing segment consists of 4 linked nucleosides, wherein the nucleosides at positions 2 and 3 of SEQ ID NO: 2 comprise a 2'-deoxy sugar, and each of the other 2 linked nucleosides comprise a nucleoside with a 2'-O(CH$_2$)$_2$—OCH$_3$ sugar. In certain embodiments, the 5' wing segment consists of 4 linked nucleosides, wherein the nucleosides at positions 2 and 4 of SEQ ID NO: 2 comprise a 2'-deoxy sugar. In certain embodiments, the 5' wing segment consists of 4 linked nucleosides, wherein the nucleosides at positions 2 and 4 of SEQ ID NO: 2 comprise a 2'-deoxy sugar, and each of the other 2 linked nucleosides comprise a nucleoside with a 2'-O(CH$_2$)$_2$—OCH$_3$ sugar. In certain embodiments, the 5' wing segment consists of 4 linked nucleosides, wherein the nucleosides at positions 3 and 4 of SEQ ID NO: 2 comprise a 2'-deoxy sugar. In certain embodiments, the 5' wing segment consists of 4 linked nucleosides, wherein the nucleosides at positions 3 and 4 of SEQ ID NO: 2 comprise a 2'-deoxy sugar, and each of the other 2 linked nucleosides comprise a nucleoside with a 2'-O(CH$_2$)$_2$—OCH$_3$ sugar.

B3. 5' Wing Segment w/4 Linked Nucleosides, 2'-LNA Combinations

In certain embodiments, the 5' wing segment consists of 4 linked nucleosides, wherein one of the 4 linked nucleosides comprise a locked nucleic acid. In certain embodiments, the 5' wing segment consists of 4 linked nucleosides, wherein two of the 4 linked nucleosides comprise a locked nucleic acid. In certain embodiments, the 5' wing segment consists of 4 linked nucleosides, wherein one of the 4 linked nucleosides comprise a 4'-CH$_2$—O-2' sugar. In certain embodiments, the 5' wing segment consists of 4 linked nucleosides, wherein two of the 4 linked nucleosides comprise a 4'-CH$_2$—O-2' sugar.

In certain embodiments, the 5' wing segment consists of 4 linked nucleosides, wherein one of the 4 linked nucleosides comprise a locked nucleic acid, and each of the other 3 linked nucleosides comprise a nucleoside with a 2'-O(CH$_2$)$_2$—OCH$_3$ sugar. In certain embodiments, the 5' wing segment consists of 4 linked nucleosides, wherein two of the 4 linked nucleosides comprise a locked nucleic acid, and each of the other 2 linked nucleosides comprise a nucleoside with a 2'-O(CH$_2$)$_2$—OCH$_3$ sugar. In certain embodiments, the 5' wing segment consists of 4 linked nucleosides, wherein one of the 4 linked nucleosides comprise a 4'-CH$_2$—O-2' sugar, and each of the other 3 linked nucleosides comprise a nucleoside with a 2'-O(CH$_2$)$_2$—OCH$_3$ sugar. In certain embodiments, the 5' wing segment consists of 4 linked nucleosides, wherein two of the 4 linked nucleosides comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 5' wing segment consists of 4 linked nucleosides, and the nucleosides at positions 1 and 3 of SEQ ID NO: 2 comprise a locked nucleic acid. In certain embodiments, the 5' wing segment consists of 4 linked nucleosides, and the nucleosides at positions 1 and 3 of SEQ ID NO: 2 comprise a 4'-CH$_2$—O-2' sugar.

In certain embodiments, the 5' wing segment consists of 4 linked nucleosides, and the nucleosides at positions 1 and 3 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 5' wing segment consists of 4 linked nucleosides, and the nucleosides at positions 1 and 3 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

C1. 5' Wing Segment w/5 Linked Nucleosides

In certain embodiments, the 5' wing segment consists of 5 linked nucleosides. In certain embodiments, the 5' wing segment consists of 5 linked nucleosides, wherein each of the 5 linked nucleosides comprise a nucleoside with a 2'-O(CH$_2$)$_2$—OCH$_3$ sugar. In certain embodiments, the 5' wing segment consists of 5 linked nucleosides, wherein 4 of the 5 linked nucleosides comprise a nucleoside with a 2'-O(CH$_2$)$_2$—OCH$_3$ sugar. In certain embodiments, the 5' wing segment consists of 5 linked nucleosides, wherein 3 of the 5 linked nucleosides comprise a nucleoside with a 2'-O(CH$_2$)$_2$—OCH$_3$ sugar. In certain embodiments, the 5' wing segment consists of 5 linked nucleosides, wherein 2 of the 5 linked nucleosides comprises a nucleoside with a 2'-O(CH$_2$)$_2$—OCH$_3$ sugar. In certain embodiments, the 5' wing segment consists of 5 linked nucleosides, wherein 1 of the 5 linked nucleosides comprises a nucleoside with a 2'-O(CH$_2$)$_2$—OCH$_3$ sugar.

C2. 5' Wing Segment w/5 Linked Nucleosides, 2'-Deoxy Combinations

In certain embodiments, the 5' wing segment consists of 5 linked nucleosides, wherein one of the linked nucleosides comprises a nucleoside with a 2'-deoxy sugar. In certain embodiments, the 5' wing segment consists of 5 linked nucleosides, wherein two of the linked nucleosides comprises a nucleoside with a 2'-deoxy sugar. In certain embodiments, the 5' wing segment consists of 5 linked nucleosides, wherein one of the 5 linked nucleosides comprises a nucleoside with a 2'-deoxy sugar, and each of the other 4 linked nucleosides comprise a nucleoside with a 2'-O(CH$_2$)$_2$—OCH$_3$ sugar. In certain embodiments, the 5' wing segment consists of 5 linked nucleosides, wherein one of the 5 linked nucleosides comprises a nucleoside with a 2'-deoxy sugar, one of the 5 linked nucleosides comprises a locked nucleic acid, and each of the other 3 linked nucleosides comprise a nucleoside with a 2'-O(CH$_2$)$_2$—OCH$_3$ sugar. In certain embodiments, the 5' wing segment consists of 5 linked nucleosides, wherein one of the 5 linked nucleosides comprises a nucleoside with a 2'-deoxy sugar, two of the 5 linked nucleosides comprise a locked nucleic acid, and the other 2 linked nucleosides comprises a nucleoside with a 2'-O(CH$_2$)$_2$—OCH$_3$ sugar.

In certain embodiments, the 5' wing segment consists of 5 linked nucleosides, wherein the nucleoside at position 2 of SEQ ID NO: 2 comprises a 2'-deoxy sugar. In certain embodiments, the 5' wing segment consists of 5 linked nucleosides, wherein the nucleoside at position 2 of SEQ ID NO: 2 comprises a 2'-deoxy sugar, and each of the other 4 linked nucleosides comprise a nucleoside with a 2'-O(CH$_2$)$_2$—OCH$_3$ sugar. In certain embodiments, the 5' wing segment consists of 5 linked nucleosides, wherein the nucleoside at position 3 of SEQ ID NO: 2 comprises a 2'-deoxy sugar. In certain embodiments, the 5' wing segment consists of 5 linked nucleosides, wherein the nucleoside at position 3 of SEQ ID NO: 2 comprises a 2'-deoxy sugar, and each of the other 4 linked nucleosides comprise a nucleoside with a 2'-O(CH$_2$)$_2$—OCH$_3$ sugar. In certain embodiments, the 5' wing segment consists of 5 linked nucleosides, wherein the nucleoside at position 4 of SEQ ID NO: 2 comprises a 2'-deoxy sugar. In certain embodiments, the 5' wing segment consists of 5 linked nucleosides, wherein the nucleoside at position 4 of SEQ ID NO: 2 comprises a 2'-deoxy sugar, and each of the other 4 linked nucleosides comprise a nucleoside with a 2'-O(CH$_2$)$_2$—OCH$_3$ sugar.

In certain embodiments, the 5' wing segment consists of 5 linked nucleosides, wherein the nucleosides at positions 2 and 3 of SEQ ID NO: 2 comprise a 2'-deoxy sugar. In certain embodiments, the 5' wing segment consists of 5 linked nucleosides, wherein the nucleosides at positions 2 and 3 of SEQ ID NO: 2 comprise a 2'-deoxy sugar, and each of the other 3 linked nucleosides comprise a nucleoside with a 2'-O(CH$_2$)$_2$—OCH$_3$ sugar. In certain embodiments, the 5' wing segment consists of 5 linked nucleosides, wherein the nucleosides at positions 2 and 4 of SEQ ID NO: 2 comprise a 2'-deoxy sugar. In certain embodiments, the 5' wing segment consists of 5 linked nucleosides, wherein the nucleosides at positions 2 and 4 of SEQ ID NO: 2 comprise a 2'-deoxy sugar, and each of the other 3 linked nucleosides comprise a nucleoside with a 2'-O(CH$_2$)$_2$—OCH$_3$ sugar. In certain embodiments, the 5' wing segment consists of 5 linked nucleosides, wherein the nucleosides at positions 3 and 4 of SEQ ID NO: 2 comprise a 2'-deoxy sugar. In certain embodiments, the 5' wing segment consists of 5 linked nucleosides, wherein the nucleosides at positions 3 and 4 of SEQ ID NO: 2 comprise a 2'-deoxy sugar, and each of the other 3 linked nucleosides comprise a nucleoside with a 2'-O(CH$_2$)$_2$—OCH$_3$ sugar.

C3. 5' Wing Segment w/5 Linked Nucleosides, 2'-LNA Combinations

In certain embodiments, the 5' wing segment consists of 5 linked nucleosides, wherein one of the 5 linked nucleosides comprise a locked nucleic acid. In certain embodiments, the 5' wing segment consists of 5 linked nucleosides, wherein two of the 5 linked nucleosides comprise a locked nucleic acid. In certain embodiments, the 5' wing segment consists of 5 linked nucleosides, wherein one of the 5 linked nucleosides comprise a 4'-CH$_2$—O-2' sugar. In certain embodiments, the 5' wing segment consists of 5 linked nucleosides, wherein two of the 5 linked nucleosides comprise a 4'-CH$_2$—O-2' sugar.

In certain embodiments, the 5' wing segment consists of 5 linked nucleosides, wherein one of the 5 linked nucleosides comprise a locked nucleic acid, and each of the other 4 linked nucleosides comprise a nucleoside with a 2'-O (CH$_2$)$_2$—OCH$_3$ sugar. In certain embodiments, the 5' wing segment consists of 5 linked nucleosides, wherein two of the 5 linked nucleosides comprise a locked nucleic acid, and each of the other 3 linked nucleosides comprise a nucleoside with a 2'-O(CH$_2$)$_2$—OCH$_3$ sugar. In certain embodiments, the 5' wing segment consists of 5 linked nucleosides, wherein one of the 5 linked nucleosides comprise a 4'-CH$_2$—O-2' sugar, and each of the other 4 linked nucleosides comprise a nucleoside with a 2'-O(CH$_2$)$_2$—OCH$_3$ sugar. In certain embodiments, the 5' wing segment consists of 5 linked nucleosides, wherein two of the 5 linked nucleosides comprise a 4'-CH$_2$—O-2' sugar, and each of the other 3 linked nucleosides comprise a nucleoside with a 2'-O (CH$_2$)$_2$—OCH$_3$ sugar.

In certain embodiments, the 5' wing segment consists of 5 linked nucleosides, and the nucleosides at positions 1 and 3 of SEQ ID NO: 2 comprise a locked nucleic acid. In certain embodiments, the 5' wing segment consists of 5 linked nucleosides, and the nucleosides at positions 1 and 3 of SEQ ID NO: 2 comprise a 4'-CH$_2$—O-2' sugar.

In certain embodiments, the 5' wing segment consists of 5 linked nucleosides, and the nucleosides at positions 1 and 3 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 5' wing segment consists of 5 linked nucleosides, and the nucleosides at positions 1 and 3 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

D. 3' Wing Segment, General

In certain embodiments, at least one of the nucleosides in the 3' wing segment comprises a 2'-O(CH$_2$)$_2$—OCH$_3$ sugar. In certain embodiments, each of the nucleosides in the 3' wing segment comprise a 2'-O(CH$_2$)$_2$—OCH$_3$ sugar. In certain embodiments, the 3' wing segment comprises a nucleoside with a 2'-deoxy sugar. In certain embodiments, the 3' wing segment comprises a nucleoside with a 2'-deoxy sugar, and the other nucleosides in the 3' wing segment comprise a 2'-O(CH$_2$)$_2$—OCH$_3$ sugar. In certain embodiments, the 3' wing segment further comprises two nucleosides each with a 2'-deoxy sugar.

In certain embodiments, one, two, three, or four of the nucleosides in the 3' wing segment comprise a sugar modification described herein. In certain embodiments, one, two, three, or four of the nucleosides in the 3' wing segment comprise a bicyclic sugar. In certain embodiments, one, two, three, or four of the nucleosides in the 3' wing segment comprise a constrained ethyl sugar.

In certain embodiments, one, two, three, or four of the nucleosides in the 3' wing segment comprise a locked nucleic acid. In certain embodiments, one, two, three, or four of the nucleosides in the 3' wing segment comprise a 4'-CH$_2$—O-2' sugar. In certain embodiments, two of the nucleosides in the 3' wing segment comprise a locked nucleic acid. In certain embodiments, two of the nucleosides in the 3' wing segment comprise a 4'-CH$_2$—O-2' sugar. In certain embodiments, three of the nucleosides in the 3' wing segment comprise a locked nucleic acid. In certain embodiments, three of the nucleosides in the 3' wing segment comprise a 4'-CH$_2$—O-2' sugar.

In certain embodiments, the nucleosides at positions 16 and 18 of SEQ ID NO: 2 comprise a locked nucleic acid. In certain embodiments, the nucleosides at positions 16 and 18 of SEQ ID NO: 2 comprise a 4'-CH$_2$—O-2' sugar. In certain embodiments, the nucleosides at positions 16 and 19 of SEQ ID NO: 2 comprise a locked nucleic acid. In certain embodiments, the nucleosides at positions 16 and 19 of SEQ ID NO: 2 comprise a 4'-CH$_2$—O-2' sugar. In certain embodiments, the nucleosides at positions 16 and 20 of SEQ ID NO: 2 comprise a locked nucleic acid. In certain embodiments, the nucleosides at positions 16 and 20 of SEQ ID NO: 2 comprise a 4'-CH$_2$—O-2' sugar. In certain embodiments, the nucleosides at positions 17 and 18 of SEQ ID NO: 2 comprise a locked nucleic acid. In certain embodiments, the nucleosides at positions 17 and 18 of SEQ ID NO: 2 comprise a 4'-CH$_2$—O-2' sugar. In certain embodiments, the nucleosides at positions 17 and 19 of SEQ ID NO: 2 comprise a locked nucleic acid. In certain embodiments, the nucleosides at positions 17 and 19 of SEQ ID NO: 2 comprise a 4'-CH$_2$—O-2' sugar. In certain embodiments, the nucleosides at positions 17 and 20 of SEQ ID NO: 2 comprise a locked nucleic acid. In certain embodiments, the nucleosides at positions 17 and 20 of SEQ ID NO: 2 comprise a 4'-CH$_2$—O-2' sugar. In certain embodiments, the nucleosides at positions 18 and 19 of SEQ ID NO: 2 comprise a locked nucleic acid. In certain embodiments, the nucleosides at positions 18 and 19 of SEQ ID NO: 2 comprise a 4'-CH$_2$—O-2' sugar. In certain embodiments, the nucleosides at positions 18 and 20 of SEQ ID NO: 2 comprise a locked nucleic acid. In certain embodiments, the nucleosides at positions 18 and 20 of SEQ ID NO: 2 comprise a 4'-CH$_2$—O-2' sugar. In certain embodiments, the nucleosides at positions 19 and 20 of SEQ ID NO: 2 comprise a locked nucleic acid. In certain embodiments, the nucleosides at positions 19 and 20 of SEQ ID NO: 2 comprise a 4'-CH$_2$—O-2' sugar.

In certain embodiments, the nucleosides at positions 17, 18, and 19 of SEQ ID NO: 2 comprise a locked nucleic acid. In certain embodiments, the nucleosides at positions 17, 18, and 19 of SEQ ID NO: 2 comprise a 4'-CH$_2$—O-2' sugar. In certain embodiments, the nucleosides at positions 17, 19, and 20 of SEQ ID NO: 2 comprise a locked nucleic acid. In certain embodiments, the nucleosides at positions 17, 19, and 20 of SEQ ID NO: 2 comprise a 4'-CH$_2$—O-2' sugar.

E1. 3' Wing Segment w/4 Linked Nucleosides

In certain embodiments, the 3' wing segment consists of 4 linked nucleosides. In certain embodiments, the 3' wing segment consists of 4 linked nucleosides, wherein each of the 4 linked nucleosides comprise a nucleoside with a 2'-O(CH$_2$)$_2$—OCH$_3$ sugar. In certain embodiments, the 3' wing segment consists of 4 linked nucleosides, wherein 3 of the 4 linked nucleosides comprise a nucleoside with a 2'-O(CH$_2$)$_2$—OCH$_3$ sugar. In certain embodiments, the 3' wing segment consists of 4 linked nucleosides, wherein 2 of the 4 linked nucleosides comprise a nucleoside with a 2'-O(CH$_2$)$_2$—OCH$_3$ sugar. In certain embodiments, the 3' wing segment consists of 4 linked nucleosides, wherein 1 of the 4 linked nucleosides comprises a nucleoside with a 2'-O(CH$_2$)$_2$—OCH$_3$ sugar.

E2. 3' Wing Segment w/4 Linked Nucleosides, 2'-Deoxy Combinations

In certain embodiments, the 3' wing segment consists of 4 linked nucleosides, wherein one of the linked nucleosides comprises a nucleoside with a 2'-deoxy sugar. In certain embodiments, the 3' wing segment consists of 4 linked nucleosides, wherein two of the linked nucleosides comprises a nucleoside with a 2'-deoxy sugar. In certain embodiments, the 3' wing segment consists of 4 linked nucleosides, wherein one of the 4 linked nucleosides comprises a nucleoside with a 2'-deoxy sugar, and each of the other 3 linked nucleosides comprise a nucleoside with a 2'-O(CH$_2$)$_2$—OCH$_3$ sugar. In certain embodiments, the 3' wing segment consists of 4 linked nucleosides, wherein one of the 4 linked nucleosides comprises a nucleoside with a 2'-deoxy sugar, one of the 4 linked nucleosides comprises a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, wherein one of the 4 linked nucleosides comprises a nucleoside with a 2'-deoxy sugar, two of the 4 linked nucleosides comprise a locked nucleic acid, and the other linked nucleoside comprises a nucleoside with a 2'-O(CH$_2$)$_2$—OCH$_3$ sugar.

E3. 3' Wing Segment w/4 Linked Nucleosides, 2'-LNA Combinations

In certain embodiments, the 3' wing segment consists of 4 linked nucleosides, wherein one of the 4 linked nucleosides comprise a locked nucleic acid. In certain embodiments, the 3' wing segment consists of 4 linked nucleosides, wherein two of the 4 linked nucleosides comprise a locked nucleic acid. In certain embodiments, the 3' wing segment consists of 4 linked nucleosides, wherein one of the 4 linked nucleosides comprise a 4'-CH$_2$—O-2' sugar. In certain embodiments, the 3' wing segment consists of 4 linked nucleosides, wherein two of the 4 linked nucleosides comprise a 4'-CH$_2$—O-2' sugar.

In certain embodiments, the 3' wing segment consists of 4 linked nucleosides, wherein one of the 4 linked nucleosides comprise a locked nucleic acid, and each of the other 3 linked nucleosides comprise a nucleoside with a 2'-O(CH$_2$)$_2$—OCH$_3$ sugar. In certain embodiments, the 3' wing segment consists of 4 linked nucleosides, wherein two of the 4 linked nucleosides comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, wherein three of the 4 linked nucleosides comprise a locked nucleic acid, and the other linked nucleoside comprises a nucleoside with a 2'-O(CH$_2$)$_2$—OCH$_3$ sugar. In certain embodiments, the 3' wing segment consists of 4 linked nucleosides, wherein one of the 4 linked nucleosides comprise a 4'-CH$_2$—O-2' sugar, and each of the other 3 linked nucleosides comprise a nucleoside with a 2'-O(CH$_2$)$_2$—OCH$_3$ sugar. In certain embodiments, the 3' wing segment consists of 4 linked nucleosides, wherein two of the 4 linked nucleosides comprise a 4'-CH$_2$—O-2' sugar, and each of the other 2 linked nucleosides comprise a nucleoside with a 2'-O(CH$_2$)$_2$—OCH$_3$ sugar. In certain embodiments, the 3' wing segment consists of 4 linked nucleosides, wherein three of the 4 linked nucleosides comprise a 4'-CH$_2$—O-2' sugar, and the other linked nucleoside comprises a nucleoside with a 2'-O(CH$_2$)$_2$—OCH$_3$ sugar.

In certain embodiments, the 3' wing segment consists of 4 linked nucleosides, and the nucleosides at positions 16 and 18 of SEQ ID NO: 2 comprise a locked nucleic acid. In certain embodiments, the 3' wing segment consists of 4 linked nucleosides, and the nucleosides at positions 16 and 18 of SEQ ID NO: 2 comprise a 4'-CH$_2$—O-2' sugar.

In certain embodiments, the 3' wing segment consists of 4 linked nucleosides, and the nucleosides at positions 16 and 18 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 16 and 18 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 16 and 19 of SEQ ID NO: 2 comprise a locked nucleic acid. In certain embodiments, the 3' wing segment consists of 4 linked nucleosides, and the nucleosides at positions 16 and 19 of SEQ ID NO: 2 comprise a 4'-CH$_2$—O-2' sugar.

In certain embodiments, the 3' wing segment consists of 4 linked nucleosides, and the nucleosides at positions 16 and 19 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 16 and 19 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 16 and 20 of SEQ ID NO: 2 comprise a locked nucleic acid. In certain embodiments, the 3' wing segment consists of 4 linked nucleosides, and the nucleosides at positions 16 and 20 of SEQ ID NO: 2 comprise a 4'-CH$_2$—O-2' sugar.

In certain embodiments, the 3' wing segment consists of 4 linked nucleosides, and the nucleosides at positions 16 and 20 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 16 and 20 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 17 and 18 of SEQ ID NO: 2 comprise a locked nucleic acid. In certain embodiments, the 3' wing segment consists of 4 linked nucleosides, and the nucleosides at positions 17 and 18 of SEQ ID NO: 2 comprise a 4'-CH$_2$—O-2' sugar.

In certain embodiments, the 3' wing segment consists of 4 linked nucleosides, and the nucleosides at positions 17 and 18 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 17 and 18 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 17 and 19 of SEQ ID NO: 2 comprise a locked nucleic acid. In certain embodiments, the 3' wing segment consists of 4 linked nucleosides, and the nucleosides at positions 17 and 19 of SEQ ID NO: 2 comprise a 4'-CH$_2$—O-2' sugar.

In certain embodiments, the 3' wing segment consists of 4 linked nucleosides, and the nucleosides at positions 17 and 19 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 17 and 19 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 17 and 20 of SEQ ID NO: 2 comprise a locked nucleic acid. In certain embodiments, the 3' wing segment consists of 4 linked nucleosides, and the nucleosides at positions 17 and 20 of SEQ ID NO: 2 comprise a 4'-CH$_2$—O-2' sugar.

In certain embodiments, the 3' wing segment consists of 4 linked nucleosides, and the nucleosides at positions 17 and 20 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 17 and 20 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 18 and 19 of SEQ ID NO: 2 comprise a locked nucleic acid. In certain embodiments, the 3' wing segment consists of 4 linked nucleosides, and the nucleosides at positions 18 and 19 of SEQ ID NO: 2 comprise a 4'-CH$_2$—O-2' sugar.

In certain embodiments, the 3' wing segment consists of 4 linked nucleosides, and the nucleosides at positions 18 and 19 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 18 and 19 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 18 and 20 of SEQ ID NO: 2 comprise a locked nucleic acid. In certain embodiments, the 3' wing segment consists of 4 linked nucleosides, and the nucleosides at positions 18 and 20 of SEQ ID NO: 2 comprise a 4'-CH$_2$—O-2' sugar.

In certain embodiments, the 3' wing segment consists of 4 linked nucleosides, and the nucleosides at positions 18 and 20 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 4 linked nucleosides, and the nucleosides at positions 18 and 20 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 4 linked nucleosides, and the nucleosides at positions 19 and 20 of SEQ ID NO: 2 comprise a locked nucleic acid. In certain embodiments, the 3' wing segment consists of 4 linked nucleosides, and the nucleosides at positions 19 and 20 of SEQ ID NO: 2 comprise a 4'-$CH_2$—O-2' sugar.

In certain embodiments, the 3' wing segment consists of 4 linked nucleosides, and the nucleosides at positions 19 and 20 of SEQ ID NO: 2 comprise a locked nucleic acid, and each of the other 2 linked nucleosides comprise a nucleoside with a 2'-O($CH_2$)$_2$—$OCH_3$ sugar. In certain embodiments, the 3' wing segment consists of 4 linked nucleosides, and the nucleosides at positions 19 and 20 of SEQ ID NO: 2 comprise a 4'-$CH_2$—O-2' sugar, and each of the other 2 linked nucleosides comprise a nucleoside with a 2'-O($CH_2$)$_2$—$OCH_3$ sugar.

In certain embodiments, the 3' wing segment consists of 4 linked nucleosides, and the nucleosides at positions 17, 18 and 19 of SEQ ID NO: 2 comprise a locked nucleic acid. In certain embodiments, the 3' wing segment consists of 4 linked nucleosides, and the nucleosides at positions 17, 18 and 19 of SEQ ID NO: 2 comprise a 4'-$CH_2$—O-2' sugar.

In certain embodiments, the 3' wing segment consists of 4 linked nucleosides, and the nucleosides at positions 17, 18 and 19 of SEQ ID NO: 2 comprise a locked nucleic acid, and the other linked nucleoside comprises a nucleoside with a 2'-O($CH_2$)$_2$—$OCH_3$ sugar. In certain embodiments, the 3' wing segment consists of 4 linked nucleosides, and the nucleosides at positions 17, 18 and 19 of SEQ ID NO: 2 comprise a 4'-$CH_2$—O-2' sugar, and the other linked nucleoside comprises a nucleoside with a 2'-O($CH_2$)$_2$—$OCH_3$ sugar.

In certain embodiments, the 3' wing segment consists of 4 linked nucleosides, and the nucleosides at positions 17, 19 and 20 of SEQ ID NO: 2 comprise a locked nucleic acid. In certain embodiments, the 3' wing segment consists of 4 linked nucleosides, and the nucleosides at positions 17, 19 and 20 of SEQ ID NO: 2 comprise a 4'-$CH_2$—O-2' sugar.

In certain embodiments, the 3' wing segment consists of 4 linked nucleosides, and the nucleosides at positions 17, 19 and 20 of SEQ ID NO: 2 comprise a locked nucleic acid, and the other linked nucleoside comprises a nucleoside with a 2'-O($CH_2$)$_2$—$OCH_3$ sugar. In certain embodiments, the 3' wing segment consists of 4 linked nucleosides, and the nucleosides at positions 17, 19 and 20 of SEQ ID NO: 2 comprise a 4'-$CH_2$—O-2' sugar, and the other linked nucleoside comprises a nucleoside with a 2'-O($CH_2$)$_2$—$OCH_3$ sugar.

F1. 3' Wing Segment w/5 Linked Nucleosides

In certain embodiments, the 3' wing segment consists of 5 linked nucleosides. In certain embodiments, the 3' wing segment consists of 5 linked nucleosides, wherein each of the 5 linked nucleosides comprise a nucleoside with a 2'-O($CH_2$)$_2$—$OCH_3$ sugar. In certain embodiments, the 3' wing segment consists of 5 linked nucleosides, wherein 4 of the 5 linked nucleosides comprise a nucleoside with a 2'-O($CH_2$)$_2$—$OCH_3$ sugar. In certain embodiments, the 3' wing segment consists of 5 linked nucleosides, wherein 3 of the 5 linked nucleosides comprise a nucleoside with a 2'-O($CH_2$)$_2$—$OCH_3$ sugar. In certain embodiments, the 3' wing segment consists of 5 linked nucleosides, wherein 2 of the 5 linked nucleosides comprises a nucleoside with a 2'-O($CH_2$)$_2$—$OCH_3$ sugar. In certain embodiments, the 3' wing segment consists of 5 linked nucleosides, wherein 1 of the 5 linked nucleosides comprises a nucleoside with a 2'-O($CH_2$)$_2$—$OCH_3$ sugar.

F2. 3' Wing Segment w/5 Linked Nucleosides, 2'-Deoxy Combinations

In certain embodiments, the 3' wing segment consists of 5 linked nucleosides, wherein one of the linked nucleosides comprises a nucleoside with a 2'-deoxy sugar. In certain embodiments, the 3' wing segment consists of 5 linked nucleosides, wherein two of the linked nucleosides comprises a nucleoside with a 2'-deoxy sugar. In certain embodiments, the 3' wing segment consists of 5 linked nucleosides, wherein one of the 5 linked nucleosides comprises a nucleoside with a 2'-deoxy sugar, and each of the other 4 linked nucleosides comprise a nucleoside with a 2'-O($CH_2$)$_2$—$OCH_3$ sugar. In certain embodiments, the 3' wing segment consists of 5 linked nucleosides, wherein one of the 5 linked nucleosides comprises a nucleoside with a 2'-deoxy sugar, one of the 5 linked nucleosides comprises a locked nucleic acid, and each of the other 3 linked nucleosides comprise a nucleoside with a 2'-O($CH_2$)$_2$—$OCH_3$ sugar. In certain embodiments, the 3' wing segment consists of 5 linked nucleosides, wherein one of the 5 linked nucleosides comprises a nucleoside with a 2'-deoxy sugar, two of the 5 linked nucleosides comprise a locked nucleic acid, and the other 2 linked nucleosides comprises a nucleoside with a 2'-O($CH_2$)$_2$—$OCH_3$ sugar.

F3. 3' Wing Segment w/5 Linked Nucleosides, 2'-LNA Combinations

In certain embodiments, the 3' wing segment consists of 5 linked nucleosides, wherein one of the 5 linked nucleosides comprise a locked nucleic acid. In certain embodiments, the 3' wing segment consists of 5 linked nucleosides, wherein two of the 5 linked nucleosides comprise a locked nucleic acid. In certain embodiments, the 3' wing segment consists of 5 linked nucleosides, wherein one of the 5 linked nucleosides comprise a 4'-$CH_2$—O-2' sugar. In certain embodiments, the 3' wing segment consists of 5 linked nucleosides, wherein two of the 5 linked nucleosides comprise a 4'-$CH_2$—O-2' sugar.

In certain embodiments, the 3' wing segment consists of 5 linked nucleosides, wherein one of the 5 linked nucleosides comprise a locked nucleic acid, and each of the other 4 linked nucleosides comprise a nucleoside with a 2'-O($CH_2$)$_2$—$OCH_3$ sugar. In certain embodiments, the 3' wing segment consists of 5 linked nucleosides, wherein two of the 5 linked nucleosides comprise a locked nucleic acid, and each of the other 3 linked nucleosides comprise a nucleoside with a 2'-O($CH_2$)$_2$—$OCH_3$ sugar. In certain embodiments, the 3' wing segment consists of 5 linked nucleosides, wherein three of the 5 linked nucleosides comprise a locked nucleic acid, and each of the other 2 linked nucleosides comprise a nucleoside with a 2'-O($CH_2$)$_2$—$OCH_3$ sugar. In certain embodiments, the 3' wing segment consists of 5 linked nucleosides, wherein one of the 5 linked nucleosides comprise a 4'-$CH_2$—O-2' sugar, and each of the other 4 linked nucleosides comprise a nucleoside with a 2'-O($CH_2$)$_2$—$OCH_3$ sugar. In certain embodiments, the 3' wing segment consists of 5 linked nucleosides, wherein two of the 5 linked nucleosides comprise a 4'-$CH_2$—O-2' sugar, and each of the other 3 linked nucleosides comprise a nucleoside with a 2'-O($CH_2$)$_2$—$OCH_3$ sugar. In certain embodiments, the 3' wing segment consists of 5 linked nucleosides, wherein three of the 5 linked nucleosides comprise a 4'-$CH_2$—O-2' sugar, and each of the other 2 linked nucleosides comprise a nucleoside with a 2'-O($CH_2$)$_2$—$OCH_3$ sugar.

In certain embodiments, the 3' wing segment consists of 5 linked nucleosides, and the nucleosides at positions 16 and 18 of SEQ ID NO: 2 comprise a locked nucleic acid. In certain embodiments, the 3' wing segment consists of 5 linked nucleosides, and the nucleosides at positions 16 and 18 of SEQ ID NO: 2 comprise a 4'-CH$_2$—O-2' sugar.

In certain embodiments, the 3' wing segment consists of 5 linked nucleosides, and the nucleosides at positions 16 and 18 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 16 and 18 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 16 and 19 of SEQ ID NO: 2 comprise a locked nucleic acid. In certain embodiments, the 3' wing segment consists of 5 linked nucleosides, and the nucleosides at positions 16 and 19 of SEQ ID NO: 2 comprise a 4'-CH$_2$—O-2' sugar.

In certain embodiments, the 3' wing segment consists of 5 linked nucleosides, and the nucleosides at positions 16 and 19 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 16 and 19 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 16 and 20 of SEQ ID NO: 2 comprise a locked nucleic acid. In certain embodiments, the 3' wing segment consists of 5 linked nucleosides, and the nucleosides at positions 16 and 20 of SEQ ID NO: 2 comprise a 4'-CH$_2$—O-2' sugar.

In certain embodiments, the 3' wing segment consists of 5 linked nucleosides, and the nucleosides at positions 16 and 20 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 16 and 20 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 17 and 18 of SEQ ID NO: 2 comprise a locked nucleic acid. In certain embodiments, the 3' wing segment consists of 5 linked nucleosides, and the nucleosides at positions 17 and 18 of SEQ ID NO: 2 comprise a 4'-CH$_2$—O-2' sugar.

In certain embodiments, the 3' wing segment consists of 5 linked nucleosides, and the nucleosides at positions 17 and 18 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 17 and 18 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 17 and 19 of SEQ ID NO: 2 comprise a locked nucleic acid. In certain embodiments, the 3' wing segment consists of 5 linked nucleosides, and the nucleosides at positions 17 and 19 of SEQ ID NO: 2 comprise a 4'-CH$_2$—O-2' sugar.

In certain embodiments, the 3' wing segment consists of 5 linked nucleosides, and the nucleosides at positions 17 and 19 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 17 and 19 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 17 and 20 of SEQ ID NO: 2 comprise a locked nucleic acid. In certain embodiments, the 3' wing segment consists of 5 linked nucleosides, and the nucleosides at positions 17 and 20 of SEQ ID NO: 2 comprise a 4'-CH$_2$—O-2' sugar.

In certain embodiments, the 3' wing segment consists of 5 linked nucleosides, and the nucleosides at positions 17 and 20 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 17 and 20 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 18 and 19 of SEQ ID NO: 2 comprise a locked nucleic acid. In certain embodiments, the 3' wing segment consists of 5 linked nucleosides, and the nucleosides at positions 18 and 19 of SEQ ID NO: 2 comprise a 4'-CH$_2$—O-2' sugar.

In certain embodiments, the 3' wing segment consists of 5 linked nucleosides, and the nucleosides at positions 18 and 19 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 18 and 19 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 18 and 20 of SEQ ID NO: 2 comprise a locked nucleic acid. In certain embodiments, the 3' wing segment consists of 5 linked nucleosides, and the nucleosides at positions 18 and 20 of SEQ ID NO: 2 comprise a 4'-CH$_2$—O-2' sugar.

In certain embodiments, the 3' wing segment consists of 5 linked nucleosides, and the nucleosides at positions 18 and 20 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 18 and 20 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 19 and 20 of SEQ ID NO: 2 comprise a locked nucleic acid. In certain embodiments, the 3' wing segment consists of 5 linked nucleosides, and the nucleosides at positions 19 and 20 of SEQ ID NO: 2 comprise a 4'-CH$_2$—O-2' sugar.

In certain embodiments, the 3' wing segment consists of 5 linked nucleosides, and the nucleosides at positions 19 and 20 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 19 and 20 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 17, 18, and 19 of SEQ ID NO: 2 comprise a locked nucleic acid. In certain embodiments, the 3' wing segment consists of 5 linked nucleosides, and the nucleosides at positions 17, 18, and 19 of SEQ ID NO: 2 comprise a 4'-CH$_2$—O-2' sugar.

In certain embodiments, the 3' wing segment consists of 5 linked nucleosides, and the nucleosides at positions 17, 18, and 19 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 17, 18 and 19 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

In certain embodiments, the 3' wing segment consists of 5 linked nucleosides, and the nucleosides at positions 17, 19, and 20 of SEQ ID NO: 2 comprise a locked nucleic acid. In certain embodiments, the 3' wing segment consists of 5 linked nucleosides, and the nucleosides at positions 17, 19, and 20 of SEQ ID NO: 2 comprise a 4'-CH$_2$—O-2' sugar.

In certain embodiments, the 3' wing segment consists of 5 linked nucleosides, and the nucleosides at positions 17, 19, and 20 of SEQ ID NO: 2 comprise a locked nucleic acid, and each of the other 2 linked nucleosides comprise a nucleoside with a 2'-O(CH$_2$)$_2$—OCH$_3$ sugar. In certain embodiments, the 3' wing segment consists of 5 linked nucleosides, and the nucleosides at positions 17, 19 and 20 of SEQ ID NO: 2 comprise a 4'-CH$_2$—O-2' sugar, and each of the other 2 linked nucleosides comprise a nucleoside with a 2'-O(CH$_2$)$_2$—OCH$_3$ sugar.

G1. 3' Wing Segment w/6 Linked Nucleosides

In certain embodiments, the 3' wing segment consists of 6 linked nucleosides. In certain embodiments, the 3' wing segment consists of 6 linked nucleosides, wherein each of the 6 linked nucleosides comprise a nucleoside with a 2'-O(CH$_2$)$_2$—OCH$_3$ sugar. In certain embodiments, the 3' wing segment consists of 6 linked nucleosides, wherein 5 of the 6 linked nucleosides comprise a nucleoside with a 2'-O(CH$_2$)$_2$—OCH$_3$ sugar. In certain embodiments, the 3' wing segment consists of 6 linked nucleosides, wherein 4 of the 6 linked nucleosides comprise a nucleoside with a 2'-O(CH$_2$)$_2$—OCH$_3$ sugar. In certain embodiments, the 3' wing segment consists of 6 linked nucleosides, wherein 3 of the 6 linked nucleosides comprise a nucleoside with a 2'-O(CH$_2$)$_2$—OCH$_3$ sugar. In certain embodiments, the 3' wing segment consists of 6 linked nucleosides, wherein 2 of the 6 linked nucleosides comprises a nucleoside with a 2'-O(CH$_2$)$_2$—OCH$_3$ sugar. In certain embodiments, the 3' wing segment consists of 6 linked nucleosides, wherein 1 of the 6 linked nucleosides comprises a nucleoside with a 2'-O(CH$_2$)$_2$—OCH$_3$ sugar.

G2. 3' Wing Segment w/6 Linked Nucleosides, 2'-Deoxy Combinations

In certain embodiments, the 3' wing segment consists of 6 linked nucleosides, wherein one of the linked nucleosides comprises a nucleoside with a 2'-deoxy sugar. In certain embodiments, the 3' wing segment consists of 6 linked nucleosides, wherein two of the linked nucleosides comprises a nucleoside with a 2'-deoxy sugar. In certain embodiments, the 3' wing segment consists of 6 linked nucleosides, wherein one of the 6 linked nucleosides comprises a nucleoside with a 2'-deoxy sugar, and each of the other 5 linked nucleosides comprise a nucleoside with a 2'-O(CH$_2$)$_2$—OCH$_3$ sugar. In certain embodiments, the 3' wing segment consists of 6 linked nucleosides, wherein one of the 6 linked nucleosides comprises a nucleoside with a 2'-deoxy sugar, one of the 6 linked nucleosides comprises a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, wherein one of the 5 linked nucleosides comprises a nucleoside with a 2'-deoxy sugar, two of the 6 linked nucleosides comprise a locked nucleic acid, and the other 3 linked nucleosides comprises a nucleoside with a 2'-O(CH$_2$)$_2$—OCH$_3$ sugar.

G3. 3' Wing Segment w/6 Linked Nucleosides, 2'-LNA Combinations

In certain embodiments, the 3' wing segment consists of 6 linked nucleosides, wherein one of the 6 linked nucleosides comprise a locked nucleic acid. In certain embodiments, the 3' wing segment consists of 6 linked nucleosides, wherein two of the 6 linked nucleosides comprise a locked nucleic acid. In certain embodiments, the 3' wing segment consists of 6 linked nucleosides, wherein one of the 6 linked nucleosides comprise a 4'-CH$_2$—O-2' sugar. In certain embodiments, the 3' wing segment consists of 6 linked nucleosides, wherein two of the 6 linked nucleosides comprise a 4'-CH$_2$—O-2' sugar.

In certain embodiments, the 3' wing segment consists of 6 linked nucleosides, wherein one of the 6 linked nucleosides comprise a locked nucleic acid, and each of the other 5 linked nucleosides comprise a nucleoside with a 2'-O(CH$_2$)$_2$—OCH$_3$ sugar. In certain embodiments, the 3' wing segment consists of 6 linked nucleosides, wherein two of the 6 linked nucleosides comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, wherein three of the 6 linked nucleosides comprise a locked nucleic acid, and each of the other 3 linked nucleosides comprise a nucleoside with a 2'-O(CH$_2$)$_2$—OCH$_3$ sugar. In certain embodiments, the 3' wing segment consists of 6 linked nucleosides, wherein one of the 6 linked nucleosides comprise a 4'-CH$_2$—O-2' sugar, and each of the other 5 linked nucleosides comprise a nucleoside with a 2'-O(CH$_2$)$_2$—OCH$_3$ sugar. In certain embodiments, the 3' wing segment consists of 6 linked nucleosides, wherein two of the 6 linked nucleosides comprise a 4'-CH$_2$—O-2' sugar, and each of the other 4 linked nucleosides comprise a nucleoside with a 2'-O(CH$_2$)$_2$—OCH$_3$ sugar. In certain embodiments, the 3' wing segment consists of 6 linked nucleosides, wherein three of the 6 linked nucleosides comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 16 and 18 of SEQ ID NO: 2 comprise a locked nucleic acid. In certain embodiments, the 3' wing segment consists of 6 linked nucleosides, and the nucleosides at positions 16 and 18 of SEQ ID NO: 2 comprise a 4'-CH$_2$—O-2' sugar.

In certain embodiments, the 3' wing segment consists of 6 linked nucleosides, and the nucleosides at positions 16 and 18 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 16 and 18 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 16 and 19 of SEQ ID NO: 2 comprise a locked nucleic acid. In certain embodiments, the 3' wing segment consists of 6 linked nucleosides, and the nucleosides at positions 16 and 19 of SEQ ID NO: 2 comprise a 4'-CH$_2$—O-2' sugar.

In certain embodiments, the 3' wing segment consists of 6 linked nucleosides, and the nucleosides at positions 16 and 19 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 16 and 19 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 16 and 20 of SEQ ID NO: 2 comprise a locked nucleic acid. In certain embodiments, the 3' wing segment consists of 6 linked nucleosides, and the nucleosides at positions 16 and 20 of SEQ ID NO: 2 comprise a 4'-CH$_2$—O-2' sugar.

In certain embodiments, the 3' wing segment consists of 6 linked nucleosides, and the nucleosides at positions 16 and 20 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 16 and 20 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 17 and 18 of SEQ ID NO: 2 comprise a locked nucleic acid. In certain embodiments, the 3' wing segment consists of 6 linked nucleosides, and the nucleosides at positions 17 and 18 of SEQ ID NO: 2 comprise a 4'-CH$_2$—O-2' sugar.

In certain embodiments, the 3' wing segment consists of 6 linked nucleosides, and the nucleosides at positions 17 and 18 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 17 and 18 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 17 and 19 of SEQ ID NO: 2 comprise a locked nucleic acid. In certain embodiments, the 3' wing segment consists of 6 linked nucleosides, and the nucleosides at positions 17 and 19 of SEQ ID NO: 2 comprise a 4'-CH$_2$—O-2' sugar.

In certain embodiments, the 3' wing segment consists of 6 linked nucleosides, and the nucleosides at positions 17 and 19 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 17 and 19 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 17 and 20 of SEQ ID NO: 2 comprise a locked nucleic acid. In certain embodiments, the 3' wing segment consists of 6 linked nucleosides, and the nucleosides at positions 17 and 20 of SEQ ID NO: 2 comprise a 4'-CH$_2$—O-2' sugar.

In certain embodiments, the 3' wing segment consists of 6 linked nucleosides, and the nucleosides at positions 17 and 20 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 17 and 20 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 18 and 19 of SEQ ID NO: 2 comprise a locked nucleic acid. In certain embodiments, the 3' wing segment consists of 6 linked nucleosides, and the nucleosides at positions 18 and 19 of SEQ ID NO: 2 comprise a 4'-CH$_2$—O-2' sugar.

In certain embodiments, the 3' wing segment consists of 6 linked nucleosides, and the nucleosides at positions 18 and 19 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 18 and 19 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 18 and 20 of SEQ ID NO: 2 comprise a locked nucleic acid. In certain embodiments, the 3' wing segment consists of 6 linked nucleosides, and the nucleosides at positions 18 and 20 of SEQ ID NO: 2 comprise a 4'-CH$_2$—O-2' sugar.

In certain embodiments, the 3' wing segment consists of 6 linked nucleosides, and the nucleosides at positions 18 and 20 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 18 and 20 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 19 and 20 of SEQ ID NO: 2 comprise a locked nucleic acid. In certain embodiments, the 3' wing segment consists of 6 linked nucleosides, and the nucleosides at positions 19 and 20 of SEQ ID NO: 2 comprise a 4'-CH$_2$—O-2' sugar.

In certain embodiments, the 3' wing segment consists of 6 linked nucleosides, and the nucleosides at positions 19 and 20 of SEQ ID NO: 2 comprise a locked nucleic acid, and each of the other 4 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 19 and 20 of SEQ ID NO: 2 comprise a 4'-CH$_2$—O-2' sugar, and each of the other 4 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 17, 18, and 19 of SEQ ID NO: 2 comprise a locked nucleic acid. In certain embodiments, the 3' wing segment consists of 6 linked nucleosides, and the nucleosides at positions 17, 18, and 19 of SEQ ID NO: 2 comprise a 4'-CH$_2$—O-2' sugar.

In certain embodiments, the 3' wing segment consists of 6 linked nucleosides, and the nucleosides at positions 17, 18, and 19 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 17, 18 and 19 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

In certain embodiments, the 3' wing segment consists of 6 linked nucleosides, and the nucleosides at positions 17, 19, and 20 of SEQ ID NO: 2 comprise a locked nucleic acid. In certain embodiments, the 3' wing segment consists of 6 linked nucleosides, and the nucleosides at positions 17, 19, and 20 of SEQ ID NO: 2 comprise a 4'-CH$_2$—O-2' sugar.

In certain embodiments, the 3' wing segment consists of 6 linked nucleosides, and the nucleosides at positions 17, 19, and 20 of SEQ ID NO: 2 comprise a locked nucleic acid, and each of the other 3 linked nucleosides comprise a nucleoside with a 2'-O(CH$_2$)$_2$—OCH$_3$ sugar. In certain embodiments, the 3' wing segment consists of 6 linked nucleosides, and the nucleosides at positions 17, 19 and 20 of SEQ ID NO: 2 comprise a 4'-CH$_2$—O-2' sugar, and each of the other 3 linked nucleosides comprise a nucleoside with a 2'-O(CH$_2$)$_2$—OCH$_3$ sugar.

H-0. Gap Segments

In some embodiments, a modified oligonucleotide comprises or consists of at least one gap segment. In some embodiments, a modified oligonucleotide comprises or consists of at least two gap segments. In some embodiments, a modified oligonucleotide comprises 1, 2, 3, 4, 5, 6, 7, 8, or 9 or 10 gap segments. Gap segments are consecutively referred to a first, a second, a third, a fourth, a fifth, a sixth, a seventh, an eight, a ninth or a tenth gap segment, respectively, with the first gap segment being nearest to the 5' end of the modified oligonucleotide and last gap segment being nearest to the 3' end of the modified oligonucleotide. In some embodiments, a modified oligonucleotide comprises or consists of 2 gap segments. In some embodiments, a modified oligonucleotide comprises or consists of 3 gap segments. In some embodiments, a modified oligonucleotide comprises or consists of 4 gap segments. In some embodiments, a modified oligonucleotide comprises or consists of 5 gap segments. In some embodiments, a modified oligonucleotide comprises or consists of 6 gap segments. In some embodiments, a modified oligonucleotide comprises or consists of 7 gap segments.

In some embodiments, a gap segment comprises or consists of 1 to 20 linked nucleosides. In some embodiments, the gap segment consists of 1 nucleoside. In some embodiments, the gap segment consists of 2 linked nucleosides. In some embodiments, the gap segment consists of 23 linked nucleosides. In some embodiments, the gap segment consists of 4 linked nucleosides. In some embodiments, the gap segment consists of 5 linked nucleosides. In some embodiments, the gap segment consists of 6 linked nucleosides. In some embodiments, the gap segment consists of 7 linked nucleosides. In some embodiments, the gap segment consists of 8 linked nucleosides. In some embodiments, the gap segment consists of 9 linked nucleosides. In some embodiments, the gap segment consists of 10 linked nucleosides.

H. First Gap Segment

In certain embodiments, the first gap segment comprises or consists of 1, 2, 3, 4, 5, 6, 7, or 8 linked nucleosides. In certain embodiments, the first gap segment comprises or consists of 4 or 5 linked nucleosides. In certain embodiments, the first gap segment comprises or consists of 4 linked nucleosides. In certain embodiments, the first gap segment comprises or consists of 5 linked nucleosides.

In certain embodiments, the first gap segment comprises or consists of 1, 2, 3, 4, 5, 6, 7, or 8 linked nucleosides, each with 2'-deoxy sugars. In certain embodiments, the first gap segment comprises or consists of 4 or 5 linked nucleosides, each with 2'-deoxy sugars. In certain embodiments, the first gap segment comprises or consists of 4 linked nucleosides, each with 2'-deoxy sugars. In certain embodiments, the first gap segment comprises or consists of 5 linked nucleosides, each with 2'-deoxy sugars.

In certain embodiments, the first gap segment, each with 2'-deoxy sugars, is positions 6, 7, 8, and 9 of SEQ ID NO: 2. In certain embodiments, the first gap segment, each with 2'-deoxy sugars, is positions 5, 6, 7, 8, and 9 of SEQ ID NO: 2. In certain embodiments, the first gap segment, each with 2'-deoxy sugars, is positions 6, 7, 8, 9, and 10 of SEQ ID NO: 2.

I. Second Gap Segment

In certain embodiments, the second gap segment comprises or consists of 1, 2, 3, 4, 5, 6, 7, or 8 linked nucleosides. In certain embodiments, the second gap segment comprises or consists of 4 or 5 linked nucleosides. In certain embodiments, the first gap segment comprises or consists of 4 linked nucleosides. In certain embodiments, the first gap segment comprises or consists of 5 linked nucleosides.

In certain embodiments, the second gap segment comprises or consists of 1, 2, 3, 4, 5, 6, 7, or 8 linked nucleosides, each with 2'-deoxy sugars. In certain embodiments, the second gap segment comprises or consists of 4 linked nucleosides, each with 2'-deoxy sugars. In certain embodiments, the second gap segment comprises or consists of 5 linked nucleosides, each with 2'-deoxy sugars. In certain embodiments, the second gap segment comprises or consists of 6 linked nucleosides, each with 2'-deoxy sugars.

In certain embodiments, the second gap segment, each with 2'-deoxy sugars, is positions 11, 12, 13, and 14 of SEQ ID NO: 2. In certain embodiments, the second gap segment, each with 2'-deoxy sugars, is positions 11, 12, 13, 14, and 15 of SEQ ID NO: 2. In certain embodiments, the second gap segment, each with 2'-deoxy sugars, is positions 11, 12, 13, 14, 15, and 16 of SEQ ID NO: 2.

J. Separator Segment

In some embodiments, the separator segment comprises 0, 1, 2, 3, 4 or 5 linked nucleosides. In some embodiments, the separator segment comprises 1 nucleoside. In some embodiments, the nucleoside comprises a modification. Exemplary modifications of the nucleoside include but are not limited to a 2'methoxyethyl nucleoside, a 2'-O-methyl nucleoside, a 2'OH nucleoside, a 2' fluoro 2'-deoxy nucleoside, a 2'-F-arabinonucleic acid (2'-F-ANA), a glycol nucleic acid (GNA) or a locked nucleic acid (LNA).

In certain embodiments, the separator segment consists of one nucleoside comprising a 2'—OCH$_3$ sugar. In certain embodiments, the separator segment consists of one nucleoside comprising a 2'-O(CH$_2$)$_2$—OCH$_3$ sugar.

In certain embodiments, the separator segment is at position 7 or 8 or 9 or 10 or 11 or 12 or 13 or 14 of SEQ ID NO: 2. In certain embodiments, the separator segment is at position 9 or 10 or 11 of SEQ ID NO: 2. In certain embodiments, the separator segment is at position 10 of SEQ ID NO: 2.

In certain embodiments, the separator segment is at position 10 of SEQ ID NO: 2 and consists of one nucleoside comprising a 2'-O(CH$_2$)$_2$—OCH$_3$ sugar. In certain embodiments, the separator segment consists of one nucleoside comprising a 2'—OCH$_3$ sugar. In certain embodiments, the separator segment is at position 7 or 8 or 9 or 10 or 11 or 12 or 13 or 14 of SEQ ID NO: 2. In certain embodiments, the separator segment is at position 9 or 10 or 11 of SEQ ID NO: 2. In certain embodiments, the separator segment is at position 10 of SEQ ID NO: 2.

In certain embodiments, the separator segment consists of one nucleoside comprising a 2'-O(CH$_2$)$_2$—OCH$_3$ sugar. In certain embodiments, the separator segment consists of one nucleoside comprising a 2'—OCH$_3$ sugar. In certain embodiments, the separator segment is at position 7 or 8 or 9 or 10 or 11 or 12 or 13 or 14 of SEQ ID NO: 2. In certain embodiments, the separator segment is at position 9 or 10 or 11 of SEQ ID NO: 2. In certain embodiments, the separator segment is at position 10 of SEQ ID NO: 2.

K. Oligonucleotide Backbone

In certain embodiments, the modified oligonucleotide is a single-stranded modified oligonucleotide. In certain embodiments, at least one internucleoside linkage is a modified internucleoside linkage. In certain embodiments, each internucleoside linkage is a phosphorothioate internucleoside linkage.

L. Modified Nucleobases

In certain embodiments, the modified oligonucleotide comprises at least one modified nucleobase. In certain embodiments, wherein the modified oligonucleotide comprises one, two, or three modified nucleobase(s). In certain embodiments, the modified nucleobase is a 5-methylcytosine. In certain embodiments, the cytosines at positions 2, 13, and 20 of SEQ ID NO: 2 are each 5-methylcytosine.

M1. 5-4-1-5-5 Modified Oligonucleotides

In certain embodiments, the modified oligonucleotide comprises: a 5' wing segment consisting of 5 linked nucleosides; a first gap segment consisting of 4 linked nucleosides with 2'-deoxy sugars; a separator segment at position 10 of SEQ ID NO:2; a second gap segment consisting of 5 linked nucleosides with 2'-deoxy sugars; and a 3' wing segment consisting of 5 linked nucleosides. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises that a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises: a 5' wing segment described in Section C1, C2, or C3; a first gap segment consisting of 4 linked nucleosides with 2'-deoxy sugars; a separator segment at position 10 of SEQ ID NO: 2; a second gap segment consisting of 5 linked nucleosides with 2'-deoxy sugars; and a 3' wing segment described in Section F1, F2, or F3. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises a sequence which is A, B, C, D, E, F, G, H, I, J, K, L, M, N, O, P, Q, R, S, T, U, V, W, X, Y, or Z.

M2. 4-5-1-5-5 Modified Oligonucleotides

In certain embodiments, the modified oligonucleotide comprises: a 5' wing segment consisting of 4 linked nucleosides; a first gap segment consisting of 5 linked nucleosides with 2'-deoxy sugars; a separator segment at position 10 of SEQ ID NO:2; a second gap segment consisting of 5 linked nucleosides with 2'-deoxy sugars; and a 3' wing segment consisting of 5 linked nucleosides. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises that a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises: a 5' wing segment described in Section B1, B2, or B3; a first gap segment consisting of 5 linked nucleosides with 2'-deoxy sugars; a separator segment at position 10 of SEQ ID NO:2; a second gap segment consisting of 5 linked nucleosides with 2'-deoxy sugars; and a 3' wing segment described in Section F1, F2, or F3. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises a sequence which is AA, AB, AC, AD, AE, AF, AG, AH, AI, AJ, AK, AL, AM, AN, or AO.

Exemplary annotations of the positions and segments of AO (AUS 1493 or SEQ ID NO: 456) is shown below.

| | 5' Wing segment | | | | First Gap segment | | | | | Separator segment | Second Gap segment | | | | | 3' Wing segment | | | | |
|---|---|---|---|---|---|---|---|---|---|---|---|---|---|---|---|---|---|---|---|---|
| Position | 1 | 2 | 3 | 4 | 5 | 6 | 7 | 8 | 9 | 10 | 11 | 12 | 13 | 14 | 15 | 16 | 17 | 18 | 19 | 20 |
| SEQ ID NO AUS # | | | | | | | | | | | | | | | | | | | | |
| 456  AUS1493 | G | C | A | G | a | g | g | t | g | A | a | g | c | g | a | A | +G | T | +G | +C |

M3. 5-4-1-6-4 Modified Oligonucleotides

In certain embodiments, the modified oligonucleotide comprises: a 5' wing segment consisting of 5 linked nucleosides; a first gap segment consisting of 4 linked nucleosides with 2'-deoxy sugars; a separator segment at position 10 of SEQ ID NO:2; a second gap segment consisting of 6 linked nucleosides with 2'-deoxy sugars; and a 3' wing segment consisting of 4 linked nucleosides. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises that a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises: a 5' wing segment described in Section C1, C2, or C3; a first gap segment consisting of 4 linked nucleosides with 2'-deoxy sugars; a separator segment at position 10 of SEQ ID NO:2; a second gap segment consisting of 6 linked nucleosides with 2'-deoxy sugars; and a 3' wing segment described in Section E1, E2, or E3. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises a sequence which is AP, AQ, AR, or AS.

M4. 4-5-1-4-6 Modified Oligonucleotides

In certain embodiments, the modified oligonucleotide comprises: a 5' wing segment consisting of 4 linked nucleosides; a first gap segment consisting of 5 linked nucleosides with 2'-deoxy sugars; a separator segment at position 10 of SEQ ID NO:2; a second gap segment consisting of 4 linked nucleosides with 2'-deoxy sugars; and a 3' wing segment consisting of 6 linked nucleosides. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises that a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises: a 5' wing segment described in Section B1, B2, or B3; a first gap segment consisting of 5 linked nucleosides with 2'-deoxy sugars; a separator segment at position 10 of SEQ ID NO:2; a second gap segment consisting of 4 linked nucleosides with 2'-deoxy sugars; and a 3' wing segment described in Section G1, G2, or G3. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises a sequence which is AT or AU.

M5. 5-4-1-4-6 Modified Oligonucleotides

In certain embodiments, the modified oligonucleotide comprises: a 5' wing segment consisting of 5 linked nucleosides; a first gap segment consisting of 4 linked nucleosides with 2'-deoxy sugars; a separator segment at position 10 of SEQ ID NO:2; a second gap segment consisting of 4 linked nucleosides with 2'-deoxy sugars; and a 3' wing segment consisting of 6 linked nucleosides. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises that a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises: a 5' wing segment described in Section C1, C2, or C3; a first gap segment consisting of 4 linked nucleosides with 2'-deoxy sugars; a separator segment at position 10 of SEQ ID NO:2; a second gap segment consisting of 4 linked nucleosides with 2'-deoxy sugars; and a 3' wing segment described in Section G1, G2, or G3. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises a sequence which is AV or AW.

M6. 4-5-1-6-4 Modified Oligonucleotides

In certain embodiments, the modified oligonucleotide comprises: a 5' wing segment consisting of 4 linked nucleosides; a first gap segment consisting of 5 linked nucleosides with 2'-deoxy sugars; a separator segment at position 10 of SEQ ID NO:2; a second gap segment consisting of 6 linked nucleosides with 2'-deoxy sugars; and a 3' wing segment consisting of 4 linked nucleosides. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises that a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises: a 5' wing segment described in Section B1, B2, or B3; a first gap segment consisting of 5 linked nucleosides with 2'-deoxy sugars; a separator segment at position 10 of SEQ ID NO:2; a second gap segment consisting of 6 linked nucleosides with 2'-deoxy sugars; and a 3' wing segment described in Section E1, E2, or E3. In an exemplary embodiment, the modified oligonucleotide of this paragraph further comprises that the cytosines at positions 2, 13, and 20 of SEQ ID NO: 2 are each 5-methylcytosine. In an exemplary embodiment, the modified oligonucleotide of this paragraph further comprises internucleoside linkages in which each is a phosphorothioate internucleoside linkage. In an exemplary embodiment, the modified oligonucleotide of this paragraph further comprises a cytosine at positions 2, 13, and 20 of SEQ ID NO: 2 are each 5-methylcytosine and further comprises internucleoside linkages in which each is a phosphorothioate internucleoside linkage.

In certain embodiments, the modified oligonucleotide comprises a sequence which is AX.

In certain embodiments, one or more modified nucleosides in the wing segment have a modified sugar. In certain embodiments, the modified sugar is a bicyclic sugar. In certain embodiments, the modified nucleoside is an LNA nucleoside. In certain embodiments, the modified nucleoside is a 2'-substituted nucleoside. In certain embodiments, 2' substituted nucleosides include nucleosides with bicyclic sugar modifications. In certain embodiments, the modified nucleoside is a 2'-MOE nucleoside. In certain embodiments, the modified nucleoside is a constrained ethyl (cEt) nucleoside. In certain embodiments, each modified nucleoside in each wing segment is independently a 2'-MOE nucleoside or a nucleoside with a bicyclic sugar modification such as a constrained ethyl (cEt) nucleoside or LNA nucleoside.

In certain embodiments, the compounds or compositions comprise a salt of the modified oligonucleotide.

In certain embodiments, the compounds or compositions further comprise a pharmaceutically acceptable carrier or diluent.

In certain embodiments, the nucleobase sequence of the modified oligonucleotide is at least 60%, 65%, 70%, 75%, 80%, 85%, 90%, 95% or 100% complementary to a HBV nucleic acid, as measured over the entirety of the modified oligonucleotide. In certain embodiments, the nucleobase sequence of the modified oligonucleotide is at least 60%, 65%, 70%, 75%, 80%, 85%, 90%, 95% or 100% complementary to SEQ ID NO: 1, as measured over the entirety of the modified oligonucleotide.

In certain embodiments, the compound or modified oligonucleotide is single-stranded.

In certain embodiments, at least one nucleoside of the modified oligonucleotide comprises a modified sugar. In certain embodiments, at least one modified sugar comprises a 2'-O-methoxyethyl group (2'-O(CH$_2$)$_2$—OCH$_3$). In certain embodiments, the modified sugar comprises a 2'-O—CH$_3$ group.

In certain embodiments, at least one modified sugar is a bicyclic sugar. In certain embodiments, at least one modified sugar the bicyclic sugar comprises a 4'-(CH$_2$)—O-2' bridge, wherein n is 1 or 2. In certain embodiments, the bicyclic sugar comprises a 4'-CH$_2$—O-2' bridge. In certain embodiments, the bicyclic sugar comprises a 4'-CH(CH$_3$)—O-2' bridge.

Methods

The disclosure provides methods of treating a subject with an HBV infection, or with an HBV-related disease, disorder, or condition, the methods comprising administering a therapeutically effective amount of the modified oligonucleotides described herein, or a pharmaceutical composition comprising same. In certain embodiments, the modified oligonucleotide comprises a sequence of any one of SEQ ID NOS: 11-666, or a modified oligonucleotide comprising 1, 2, 3, 4, or 5 modifications thereto.

In certain embodiments, the modified oligonucleotides or pharmaceutical compositions comprising same inhibit HBV mRNA expression in the subject. In certain embodiments, the modified oligonucleotides or pharmaceutical compositions comprising same inhibit HBV DNA levels in the subject. In certain embodiments, the modified oligonucleotides or pharmaceutical compositions comprising same inhibit HBV protein levels and/or antigen levels in the subject. The modified oligonucleotides of the disclosure, when administered to a subject, can reduce the levels of HBV mRNA, DNA, or protein, including HBV antigens such as, but not limited to HBsAg and HbeAg.

The disclosure provides methods for treating a HBV-related disease, disorder, and/or condition in an subject, the methods comprising administering a therapeutically effective amount of any pharmaceutical composition as described above to a subject in need thereof, so as to treat the HBV-related diseases, disorders, and condition. In certain embodiments, the subject is a mammal. In certain embodiments, the subject is a human and the HBV-related disease, disorder, and condition is a hepatitis B virus infection from a human hepatitis B virus. More particularly, the human hepatitis B virus may be any of the human geographical genotypes: A (Northwest Europe, North America, Central America); B (Indonesia, China, Vietnam); C (East Asia, Korea, China, Japan, Polynesia, Vietnam); D (Mediterranean area, Middle East, India); E (Africa); F (Native Americans, Polynesia); G (United States, France); or H (Central America).

In certain embodiments, the modified oligonucleotides target a region of a HBV nucleic acid. In certain embodiments, such modified oligonucleotides targeted to a region of a HBV nucleic acid have a contiguous nucleobase portion that is complementary to an equal length nucleobase portion of the region of the HBV nucleic acid. For example, the portion can be at least an 8, 9, 10, 11, 12, 13, 14, 15, 16, 17, 18, 19 or 20 contiguous nucleobases portion complementary to an equal length portion of a region recited herein.

Certain embodiments provide methods of treating a HBV related disease, disorder, or condition in a subject, comprising administering to the subject in need thereof a modified oligonucleotide, for example a modified oligonucleotide comprising any one of SEQ ID NOS: 11-666, or a modified oligonucleotide comprising 1, 2, 3, 4, or 5 modifications thereto, or pharmaceutical composition described herein.

Certain embodiments provide a method of reducing HBV expression in a subject comprising administering to the subject a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition described herein.

Certain embodiments provide a method of preventing, ameliorating or treating an HBV-related disease, disorder or condition in a subject comprising administering to the animal a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition described herein.

Examples of HBV-related diseases, disorders or conditions include, but are not limited to, chronic HBV infection, jaundice, liver cancer, liver inflammation, liver fibrosis, liver cirrhosis, liver failure, diffuse hepatocellular inflammatory disease, hemophagocytic syndrome, serum hepatitis, and HBV viremia. HBV-related conditions or disorders can have symptoms which may include any or all of the following: flu-like illness, weakness, aches, headache, fever, loss of appetite, diarrhea, nausea and vomiting, pain over the liver area of the body, clay- or grey-colored stool, itching all over, and dark-colored urine, which when coupled with a positive test for presence of a hepatitis B virus, a hepatitis B viral antigen, or a positive test for the presence of an antibody specific for a hepatitis B viral antigen indicate an HBV-related condition or disorder.

Certain embodiments provide a method of reducing HBV mRNA expression in a subject comprising administering to the subject a modified oligonucleotide, for example a modified oligonucleotide comprising any one of SEQ ID NOS: 11-666, or a modified oligonucleotide comprising 1, 2, 3, 4, or 5 modifications thereto, or pharmaceutical composition described herein. In certain embodiments, reduction of HBV mRNA expression in the subject prevents, ameliorates or treats an HBV-related disease, disorder or condition. In certain embodiments, reduction of HBV mRNA expression in the subject ameliorates or treats HBV infection. In certain embodiments, reduction of HBV mRNA expression in the subject prevents, ameliorates or treats liver disease. In certain embodiments, the HBV mRNA expression is reduced by at least 5%, 10%, 20%, 30%, 35%, 40%, 45%, 50%, 55%, 60%, 65%, 70%, 75%, 80%, 85%, 90%, 95% or 100%.

Certain embodiments provide a method of reducing HBV protein levels in an subject comprising administering to the subject a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition described herein. In certain embodiments, reduction of HBV protein levels in the subject prevents, ameliorates or treats an HBV-related disease, disorder or condition. In certain embodiments, reduction of HBV protein levels in an subject ameliorates or treats HBV infection. In certain embodiments, reduction of HBV protein levels in the subject prevents, ameliorates or treats liver disease. In certain embodiments, the HBV protein level is reduced by at least 5%, 10%, 20%, 30%, 35%, 40%, 45%, 50%, 55%, 60%, 65%, 70%, 75%, 80%, 85%, 90%, 95% or 100%.

Certain embodiments provide a method of reducing HBV DNA levels in a subject comprising administering to the subject a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition described herein. In certain embodiments, reduction of HBV DNA levels in the subject prevents, ameliorates or treats an HBV-related disease, disorder or condition. In certain embodiments, the subject may be a mammal such as a human, and the hepatitis B virus may be a human hepatitis B virus. More particularly, the human hepatitis B virus may be any of the human geographical genotypes: A (Northwest Europe, North America, Central America); B (Indonesia, China, Vietnam); C (East Asia, Korea, China, Japan, Polynesia, Vietnam); D (Mediterranean area, Middle East, India); E (Africa); F (Native Americans, Polynesia); G (United States, France); or H (Central America). In certain embodiments, reduction of HBV DNA levels in a subject ameliorates or treats HBV infection. In certain embodiments, reduction of HBV DNA levels in a subject prevents, ameliorates or treats liver disease. In certain embodiments, the HBV DNA level is reduced by at least 5%, 10%, 20%, 30%, 35%, 40%, 45%, 50%, 55%, 60%, 65%, 70%, 75%, 80%, 85%, 90%, 95% or 100%.

Certain embodiments provide a method of reducing HBV antigen levels in a subject comprising administering to the subject a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition described herein. In certain embodiments, the antigen is HBsAg or HBeAG. In certain embodiments, reduction of HBV antigen levels in the subject prevents, ameliorates or treats an HBV-related disease, disorder or condition. In certain embodiments, reduction of HBV antigen levels in the subject prevents, ameliorates or treats liver disease. In certain embodiments, the HBV antigen levels are reduced by at least 5%, 10%, 20%, 30%, 35%, 40%, 45%, 50%, 55%, 60%, 65%, 70%, 75%, 80%, 85%, 90%, 95% or 100%.

Certain embodiments provide a method of reducing HBV DNA and HBV antigen in a subject infected with a hepatitis B virus, comprising administering to the subject a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition described herein. In certain embodiments, the antigen is HBsAg or HBeAg. In certain embodiments, the amount of HBV antigen may be sufficiently reduced to result in seroconversion, defined as serum HBeAg absence plus serum HBeAb presence if monitoring HBeAg as the determinant for seroconversion, or defined as serum HBsAg absence if monitoring HBsAg as the determinant for seroconversion, as determined by currently available detection limits of commercial ELISA systems.

Certain embodiments provide a method for treating a subject with a HBV related disease, disorder or condition comprising: a) identifying said subject with the HBV related disease, disorder or condition, and b) administering to said subject a therapeutically effective amount of a modified oligonucleotide or pharmaceutical composition described herein. In certain embodiments, the therapeutically effective amount of the modified oligonucleotide or pharmaceutical composition administered to the subject treats or reduces the HBV related disease, disorder or condition, or a symptom thereof, in the subject. In certain embodiments, the HBV related disease, disorder or condition is a liver disease. In certain embodiments, the related disease, disorder or condition is chronic HBV infection, jaundice, liver cancer such as hepatocellular carcinoma, liver inflammation, liver fibrosis, liver cirrhosis, liver failure, diffuse hepatocellular inflammatory disease, hemophagocytic syndrome, serum hepatitis, HBV viremia, liver disease-related to transplantation, or any combination thereof.

Certain embodiments provide a method for treating a subject with a HBV related disease, disorder or condition comprising: a) identifying said subject with the HBV related disease, disorder or condition, and b) administering to said subject a therapeutically effective amount of a modified oligonucleotide or pharmaceutical composition described herein. In certain embodiments, the therapeutically effective amount of the modified oligonucleotide or pharmaceutical composition administered to the subject treats or reduces the HBV related disease, disorder or condition, or a symptom thereof, in the subject. In certain embodiments, the HBV related disease, disorder or condition is a liver disease. In certain embodiments, the related disease, disorder or condition is chronic HBV infection, jaundice, liver cancer, liver inflammation, liver fibrosis, liver cirrhosis, liver failure, diffuse hepatocellular inflammatory disease, hemophagocytic syndrome, serum hepatitis, HBV viremia, or liver disease-related to transplantation.

In certain embodiments, HBV has the sequence as set forth in GenBank Accession Numbers U95551.1 (SEQ ID NO: 3) or any variant or fragment thereof. In certain embodiments, HBV has the sequence set forth in SEQ ID NOS: 667-674.

In certain embodiments, the subject is a human.

In certain embodiments, the subject is a monkey, for example a cynomolgus monkey.

In certain embodiments, the subject is a rodent, such as a mouse or rat.

In certain embodiments, the modified oligonucleotides or pharmaceutical compositions are designated as a first agent. In certain embodiments, the methods comprise administering a first agent and one or more second agents. In certain embodiments, the first agent and one or more second agents are co-administered. In certain embodiments the first agent and one or more second agents are co-administered sequentially or concomitantly. In certain embodiments, the first agent and one or more second agents are not co-administered.

In certain embodiments, the one or more second agents are also a compound or composition described herein. In certain embodiments, the one or more second agents are different from a compound or composition described herein. Examples of one or more second agents include, but are not limited to, an anti-inflammatory agent, chemotherapeutic agent or anti-infection agent. In specific embodiments, the disease comprises liver cancer, and the one or more second agents comprises a chemotherapeutic agent, such as Gemcitabine (Gemzar), Oxaliplatin (Eloxatin), Cisplatin, Doxorubicin, 5-Fluorouracil, Capecitabine (Xeloda), or Mitoxantrone (Novantrone). In specific embodiments, the disease comprises liver disease, and the one or more second agents comprise corticosteroids, diuretics, beta-blockers, or a combination thereof.

Modified oligonucleotides of the disclosure, and pharmaceutical compositions comprising same, can be administered to the subject by any suitable route of administration.

Examples of routes of administration include parenteral, e.g., intravenous, intradermal, subcutaneous, oral (e.g., inhalation), transdermal (topical), intraperitoneal (into the body cavity) and transmucosal administration.

In certain embodiments, administration comprises parenteral administration. In certain embodiments, administration comprises subcutaneous administration. In certain embodiments, administration comprises intravenous injection or infusion.

Certain embodiments provide a method for reducing an amount of HBV mRNA, DNA, protein and/or an amount of HBV antigen in a subject infected with a hepatitis B virus, the method comprising administering a therapeutically effective amount of a pharmaceutical composition as described above to the subject in need thereof so as to reduce the hepatitis B virus infection and the hepatitis B antigen, compared to the amount of HBV mRNA, protein and an amount of HBV antigen in the subject before treatment. In some embodiments, the subject may be human, and the hepatitis B virus may be a human hepatitis B virus. More particularly, the human hepatitis B virus may be any of the human geographical genotypes: A (Northwest Europe, North America, Central America); B (Indonesia, China, Vietnam); C (East Asia, Korea, China, Japan, Polynesia, Vietnam); D (Mediterranean area, Middle East, India); E (Africa); F (Native Americans, Polynesia); G (United States, France); or H (Central America).

The disclosure provides methods for reducing an amount of HBV mRNA, DNA, protein and/or an amount of HBV antigen, or a combination thereof, in a subject infected with a hepatitis B virus, the method comprising administering a therapeutically effective amount of a modified oligonucleotide or pharmaceutical composition comprising same as described above to the subject so as to reduce the hepatitis B virus infection and the hepatitis B antigen, compared to the amount of HBV mRNA, protein and/or an amount of HBV antigen in the subject before treatment. In certain embodiments, the amount of mRNA is reduced at least 10%, at least 20%, at least 30%, at least 40%, at least 50%, at least 60%, at least 70%, at least 80%, at least 90%, at least 95%, or at least 99% compared to the amount before administration of the modified antisense oligonucleotide or pharmaceutical composition. In certain embodiments, the amount of mRNA is reduced at least 50% compared to the amount before administration of the modified antisense oligonucleotide or pharmaceutical composition. In certain embodiments, the amount of mRNA is reduced at least 60% compared to the amount before administration of the modified antisense oligonucleotide or pharmaceutical composition. In certain embodiments, the amount of mRNA is reduced at least 70% compared to the amount before administration of the modified antisense oligonucleotide or pharmaceutical composition. In certain embodiments, the amount of mRNA is reduced at least 80% compared to the amount before administration of the modified antisense oligonucleotide or pharmaceutical composition. In certain embodiments, the amount of mRNA is reduced at least 90% compared to the amount before administration of the modified antisense oligonucleotide or pharmaceutical composition.

The disclosure provides methods for reducing an amount of HBV mRNA, DNA, protein and/or an amount of HBV antigen in a subject infected with a hepatitis B virus, the method comprising administering a therapeutically effective amount of a modified oligonucleotide or pharmaceutical composition as described above to the subject so as to reduce the hepatitis B virus infection and the hepatitis B antigen, compared to the amount of HBV virus, mRNA, DNA, protein and/or an amount of HBV antigen in the subject before treatment, wherein the amount of mRNA is reduced at least 75% compared to the amount before administration of the modified oligonucleotide or pharmaceutical composition. In certain embodiments, the methods reduce an amount of HBV virus, mRNA, DNA, protein and/or an amount of HBV antigen in a subject infected with a hepatitis B virus, the method comprising administering a therapeutically effective amount of a modified oligonucleotide or pharmaceutical composition as described above to the subject so as to reduce the hepatitis B virus infection and the hepatitis B antigen, compared to the amount of hepatitis B virus and HBV antigen in the subject before treatment, wherein the amount of mRNA is reduced at least 80% compared to the amount before administration of the modified oligonucleotide or pharmaceutical composition. In certain embodiments, the methods reduce an amount of HBV virus, mRNA, DNA, protein and/or an amount of HBV antigen in a subject infected with a hepatitis B virus, the method comprising administering a therapeutically effective amount of a modified oligonucleotide or pharmaceutical composition as described above to the subject so as to reduce the hepatitis B virus infection and the hepatitis B antigen, compared to the amount of HBV virus, mRNA, DNA protein and/or an amount of HBV antigen in the subject before treatment, wherein the amount of mRNA is reduced at least 85% compared to the amount before administration of the modified oligonucleotide or pharmaceutical composition. In certain embodiments, the methods reduce an amount of HBV virus, mRNA, DNA, protein and/or an amount of HBV antigen in a subject infected with a hepatitis B virus, the method comprising administering a therapeutically effective amount of a modified oligonucleotide or pharmaceutical composition as described above to the subject so as to reduce the hepatitis B virus infection and the hepatitis B antigen, compared to the amount of HBV virus, mRNA, DNA, protein and/or an amount of HBV antigen in the subject before treatment, wherein the amount of mRNA is reduced at least 90% compared to the amount before administration of the modified oligonucleotide or pharmaceutical composition. In certain embodiments, the methods reduce an amount of HBV virus, mRNA, DNA, protein and/or an amount of HBV antigen in a subject infected with a hepatitis B virus, the method comprising administering a therapeutically effective amount of a modified oligonucleotide or pharmaceutical composition as described above to the subject so as to reduce the hepatitis B virus infection, mRNA, protein and/or the hepatitis B antigen, compared to the amount of HBV mRNA, protein and/or an amount of HBV antigen in the subject before treatment, wherein the amount of mRNA is reduced at least 95% compared to the amount before administration of the modified oligonucleotide or pharmaceutical composition. In related methods, the HBV antigen may be HBsAg or may be HBeAg, and more particularly, the amount of HBV antigen may be sufficiently reduced to result in seroconversion, defined as serum HBeAg absence plus serum HBeAb presence if monitoring HBeAg as the determinant for seroconversion, or defined as serum HBsAg absence if monitoring HBsAg as the determinant for seroconversion, as determined by currently available detection limits of commercial ELISA systems.

The disclosure provides methods for promoting seroconversion of a hepatitis B virus in a mammal infected with HBV, the method comprising administering a therapeutically effective amount of a modified oligonucleotide, for example a modified oligonucleotide comprising any one of SEQ ID NOS: 11-666, or a modified oligonucleotide comprising 1, 2, 3, 4, or 5 modifications thereto, or pharmaceutical composition as described above to a subject infected with hepatitis B; monitoring for presence of HBeAg plus HBeAb in a serum sample of the subject, or monitoring for presence of HBsAg in a serum sample of the subject, such that the absence of HBeAg plus the presence of HBeAb in the serum sample if monitoring HBeAg as the determinant for seroconversion, or the absence of HBsAg in the serum sample if monitoring HBsAg as the determinant for seroconversion, as determined by current detection limits of commercial ELISA systems, is indication of seroconversion in the subject.

Certain embodiments provide the use of a modified oligonucleotide, for example a modified oligonucleotide comprising any one of SEQ ID NOS: 11-666, or a modified oligonucleotide comprising 1, 2, 3, 4, or 5 modifications thereto, or a pharmaceutical composition as described herein for preventing, ameliorating or treating liver disease, or symptom thereof, in an subject.

In some embodiments, $EC_{50}$ of cells treated with a modified oligonucleotide (e.g., SEQ ID NO: 11-666) was measured as a proxy for the effectiveness of the modified oligonucleotide. In some embodiments, the $EC_{50}$ is about 0.1 nM to about 250 nM. In some embodiments, the $EC_{50}$ is less than 250 nM, less than 200 nM, less than 150 nM, less than 100 nM, less than 90 nM, less than 80 nM, less than 70 nM, less than 65 nM, less than 60 nM, less than 55 nM, less than 50 nM, less than 49 nM, less than 47 nM, less than 46 nM, less than 45 nM, less than 44 nM, less than 43 nM, less than 42 nM, less than 41 nM, less than 40 nM, less than 39 nM, less than 38 nM, less than 37 nM, less than 36 nM, less than 35 nM, less than 34 nM, less than 33 nM, less than 32 nM, less than 31 nM, less than 30 nM, less than 29 nM, less than 28 nM, less than 27 nM, less than 26 nM, less than 25 nM, less than 24 nM, less than 23 nM, less than 22 nM, less than 21 nM, less than 20 nM, less than 19 nM, less than 18 nM, less than 17 nM, less than 16 nM, less than 15 nM, less than 14 nM, less than 13 nM, less than 12 nM, less than 11 nM, less than 10 nM, less than 9 nM, less than 8 nM, less than 7 nM, less than 6 nM, less than 5 nM, less than 4 nM, less than 3 nM, less than 2 nM, less than 1 nM, less than 0.9 nM, less than 0.8 nM, less than 0.7 nM, less than 0.6 nM, less than 0.5 nM, less than 0.4 nM, less than 0.3 nM, less than 0.2 nM or less than 0.1 nM.

In some embodiments, the ratio of $EC_{50}$ of cells treated with a modified oligonucleotide (e.g., SEQ ID NO: 11-666)/ EC50 of cells treated with a reference oligonucleotide (e.g., SEQ ID NO: 10) is calculated as a measure of efficacy in reducing HBsAg levels. In some embodiments, the ratio is about 0.05 to about 250. In some embodiments, the $EC_{50}$ ratio is less than 250, less than 150, less than 100, less than 90, less than 80, less than 70, less than 65, less than 60, less than 55, less than 50, less than 49, less than 47, less than 46, less than 45, less than 44, less than 43, less than 42, less than 41, less than 40, less than 39, less than 38, less than 37, less than 36, less than 35, less than 34, less than 33, less than 32, less than 31, less than 30, less than 29, less than 28, less than 27, less than 26, less than 25, less than 24, less than 23, less than 22, less than 21, less than 20, less than 19, less than 18, less than 17, less than 16, less than 15, less than 14, less than 13, less than 12, less than 11, less than 10, less than 9, less than 8, less than 7, less than 6, less than 5, less than 4, less than 3, less than 2, less than 1, less than 0.9, less than 0.8, less than 0.7, less than 0.6, less than 0.5, less than 0.4, less than 0.3, less than 0.2 or less than 0.1.

In certain embodiments, the compounds or compositions as described herein are efficacious by virtue of having at least one of an in vitro $IC_{50}$ of less than 250 nM, less than 200 nM, less than 150 nM, less than 100 nM, less than 90 nM, less than 80 nM, less than 70 nM, less than 65 nM, less than 60 nM, less than 55 nM, less than 50 nM, less than 49 nM, less than 47 nM, less than 46 nM, when delivered to HepG2.2.1 cells.

In certain embodiments, the compounds or compositions as described herein are efficacious by virtue of having at least one of an in vitro $IC_{50}$ of less than 250 nM, less than 200 nM, less than 100 nM, less than 90 nM, less than 80 nM, less than 70 nM, less than 60 nM, less than 50 nM, less than 40 nM, less than 35 nM, less than 34 nM, less than 33 nM, less than 32 nM, less than 31 nM, when delivered to HepG2.2.1 cells.

In certain embodiments, the compounds or compositions as described herein are efficacious by virtue of having at least one of an in vitro $IC_{50}$ of less than 20 μM, less than 10 μM, less than 9.5 M, less than 9.0 μM, less than 8.5 μM, less than 8.0 μM, less than 7.5 μM, less than 7.0 μM, less than 6.5 μM, less than 6.0 μM, less than 5.5 μM, less than 5.0 M, less than 4.5 μM, less than 4.0 μM, less than 3.5 μM, less than 3.0 μM, less than 2.5 μM, when delivered to HepG2.2.1 cells as described herein.

In some embodiments, the MTT CC25 value (nM) is used as a measure of cellular toxicity. In some embodiments the MTT CC25 of cells treated with the modified oligonucleotide described herein is about 10 nM to about 250 nM. In some embodiments the MTT CC25 is greater than 10 nM, greater than 15 nM, greater than 20 nM, greater than 25 nM, greater than 30 nM, greater than 35 nM, greater than 40 nM, greater than 45 nM, greater than 50 nM, greater than 55 nM, greater than 60 nM, greater than 65 nM, greater than 70 nM, greater than 75 nM, greater than 80 nM, greater than 85 nM, greater than 90 nM, greater than 95 nM, greater than 100 nM, greater than 110 nM, greater than 120 nM, greater than 130 nM, greater than 140 nM, greater than 150 nM, greater than 160 nM, greater than 170 nM, greater than 180 nM, greater than 190 nM, greater than 200 nM, greater than 210 nM, greater than 220 nM, greater than 230 nM, greater than 240 nM or greater than 250 nM.

In some embodiments, the CCK8 CC30 (nM) is used as a measure of cellular toxicity. In some embodiments, the CCK8 CC30 of cells treated with the modified oligonucleotide described herein is about 10 nM to about 250 nM. In some embodiments, the CCK8 CC30 is greater than 10 nM, greater than 15 nM, greater than 20 nM, greater than 25 nM, greater than 30 nM, greater than 35 nM, greater than 40 nM, greater than 45 nM, greater than 50 nM, greater than 55 nM, greater than 60 nM, greater than 65 nM, greater than 70 nM, greater than 75 nM, greater than 80 nM, greater than 85 nM, greater than 90 nM, greater than 95 nM, greater than 100 nM, greater than 110 nM, greater than 120 nM, greater than 130 nM, greater than 140 nM, greater than 150 nM, greater than 160 nM, greater than 170 nM, greater than 180 nM, greater than 190 nM, greater than 200 nM, greater than 210 nM, greater than 220 nM, greater than 230 nM, greater than 240 nM or greater than 250 nM.

In some embodiments, the "C/E ratio" is used as a measure of efficacy in reducing HBsAg levels relative to cellular toxicity. In some embodiments, the C/E ratio is calculated by taking the ratio of MTT CC25 (nM) of a modified oligonucleotide/MTT CC25 (nM) of a reference oligonucleotide (e.g., SEQ ID NO: 10) and dividing it by the ratio of HBsAg $EC_{50}$ of a modified oligonucleotide (e.g., SEQ ID NO: 11-666)/HBsAg EC50 of a reference oligonucleotide (e.g., SEQ ID NO: 10). In some embodiments, the C/E ratio is calculated by taking the ratio of CCK8 CC25 (nM) of a modified oligonucleotide/CCK8 CC25 (nM) of a reference oligonucleotide (e.g., SEQ ID NO: 10) and dividing it by the ratio of HBsAg $EC_{50}$ of a modified oligonucleotide (e.g., SEQ ID NO: 11-666)/HBsAg EC50 of a reference oligonucleotide (e.g., SEQ ID NO: 10). In some embodiments, the C/E ratio is about 0.01 to about 50. In some embodiments, the C/E ratio is greater than 1, greater than 1.1, greater than 1.2, greater than 1.3, greater than 1.4, greater than 1.5, greater than 1.6, greater than 1.7, greater than 1.8, greater than 1.9, greater than 2.0, greater than 2.1, greater than 2.2, greater than 2.3, greater than 2.4, greater than 2.5, greater than 2.6, greater than 2.7, greater than 2.8, greater than 2.9, greater than 3.0, greater than 10, greater than 11, greater than 12, greater than 13, greater than 14, greater than 15, greater than 16, greater than 17, greater than 18, greater than 19, greater than 20, greater than 21, greater than 22, greater than 23, greater than 24, greater than 25, greater than 30, greater than 35, greater than 40, greater than 45 or greater than 50.

In certain embodiments, the compounds or compositions as described herein are highly tolerable as demonstrated by having at least one of an increase an ALT or AST value of no more than 4 fold, 3 fold, or 2 fold over saline treated animals or an increase in liver, spleen, or kidney weight of no more than 30%, 20%, 15%, 12%, 10%, 5%, or 2%. In certain embodiments, the compounds or compositions as described herein are highly tolerable as demonstrated by having no increase of ALT or AST over saline treated animals. In certain embodiments, the compounds or compositions as described herein are highly tolerable as demonstrated by having no increase in liver, spleen, or kidney weight over saline treated animals.

In some embodiments, animals treated with the compounds or compositions comprising the modified oligonucleotides (e.g., SEQ ID NOS: 11-666) have a ALT level that is about 1.1 fold to about 10 fold decreased relative to an animal treated with a reference compound (e.g., SEQ ID NO: 10). In some embodiments, animals treated with the compounds or compositions comprising the modified oligonucleotides (e.g., SEQ ID NOS: 11-666) have a ALT level that is at least 1.25 fold decreased relative to an animal treated with a reference compound (e.g., SEQ ID NO: 10). In some embodiments, animals treated with the compounds or compositions comprising the modified oligonucleotides (e.g., SEQ ID NOS: 11-666) have a ALT level that is are 1.1 fold, 1.2 fold, 1.3 fold, 1.4 fold, 1.5 fold, 1.6 fold, 1.7 fold, 1.8 fold, 1.9 fold, 2.0 fold, 2.1 fold, 2.2 fold, 2.3, fold, 2.4 fold, 2.5 fold, 2.6 fold, 2.7 fold, 2.8 fold, 2.9 fold, 3.0 fold, 3.1 fold, 3.2 fold, 3.3 fold, 3.4 fold, 3.5 fold, 3.6 fold, 3.7 fold, 3.8 fold, 3.9 fold, 4.0 fold, 4.1 fold, 4.2 fold, 4.3 fold, 4.4 fold, 4.5 fold, 4.6 fold, 4.7 fold, 4.8 fold, 4.9 fold or 5.0 fold decreased relative to an animal treated with a reference compound (e.g., SEQ ID NO: 10).

In some embodiments, animals treated with the compounds or compositions comprising the modified oligonucleotides (e.g., SEQ ID NOS: 11-666) have a AST level that is about 1.1 fold to about 10 fold decreased relative to an animal treated with a reference compound (e.g., SEQ ID NO: 10). In some embodiments, animals treated with the compounds or compositions comprising the modified oligonucleotides (e.g., SEQ ID NOS: 11-666) have a AST level that is at least 1.25 fold decreased relative to an animal treated with a reference compound (e.g., SEQ ID NO: 10). In some embodiments, animals treated with the compounds or compositions comprising the modified oligonucleotides (e.g., SEQ ID NOS: 11-666) have a AST level that is are 1.1 fold, 1.2 fold, 1.3 fold, 1.4 fold, 1.5 fold, 1.6 fold, 1.7 fold, 1.8 fold, 1.9 fold, 2.0 fold, 2.1 fold, 2.2 fold, 2.3, fold, 2.4 fold, 2.5 fold, 2.6 fold, 2.7 fold, 2.8 fold, 2.9 fold, 3.0 fold, 3.1 fold, 3.2 fold, 3.3 fold, 3.4 fold, 3.5 fold, 3.6 fold, 3.7 fold, 3.8 fold, 3.9 fold, 4.0 fold, 4.1 fold, 4.2 fold, 4.3 fold, 4.4 fold, 4.5 fold, 4.6 fold, 4.7 fold, 4.8 fold, 4.9 fold or 5.0 fold decreased relative to an animal treated with a reference compound (e.g., SEQ ID NO: 10).

Certain embodiments provide the use of a modified oligonucleotide, for example a modified oligonucleotide comprising any one of SEQ ID NOS: 11-666, or a pharmaceutical composition as described herein for the manufacture of a medicament for treating, ameliorating, delaying or preventing an HBV-related disease, disorder or condition in an animal.

Certain embodiments provide the use of a modified oligonucleotide, for example a modified oligonucleotide comprising any one of SEQ ID NOS: 11-666, or a pharmaceutical composition as described herein for the manufacture of a medicament for treating, ameliorating, delaying or preventing liver disease in an animal.

Kits and Articles of Manufacture

The disclosure provides kits comprising the modified oligonucleotides described herein, and pharmaceutical compositions comprising same. In some embodiments, the modified oligonucleotide comprises a sequence of any one of SEQ ID NOS: 11-666, or a modified oligonucleotide comprising 1, 2, 3, 4, or 5 modifications thereto.

Certain embodiments provide a kit for treating, preventing, or ameliorating an HBV-related disease, disorder or condition, or a symptom thereof, as described herein wherein the kit comprises: a) a compound or compositions as described herein, for example a composition comprising a modified oligonucleotide comprising a sequence of any one of SEQ ID NOS: 11-666, or a modified oligonucleotide comprising 1, 2, 3, 4, or 5 modifications thereto; and optionally b) an additional agent or therapy as described herein. The kit can further include instructions or a label for using the kit to treat, prevent, or ameliorate the HBV-related disease, disorder or condition.

Compositions comprising modified oligonucleotides can be lyophilized before being packaged in the kit, or can be provided in solution with a pharmaceutically acceptable carrier, diluent of excipient.

In certain embodiments, the kit further comprises at least one additional agent for the treatment of an HBV-related disease, disorder or condition.

Dosing and Administration

The disclosure provides methods comprising administering a therapeutically effective dose of the modified oligonucleotides, for example a modified oligonucleotide comprising any one of SEQ ID NOS: 11-666, or a modified oligonucleotide comprising 1, 2, 3, 4, or 5 modifications thereto, or a pharmaceutical composition comprising same, to a subject in need thereof.

In certain embodiments, a therapeutically effective dose of the for example a modified oligonucleotides, or pharmaceutical compositions comprising same, comprises a dose at which a maximum log 10 serum HBsAg reduction of at least-0.2, at least-0.3, at least-0.4, at least-0.5, at least-0.7, at least-1.0. at least-1.5, at least-2.0, at least-2.5, at least-3.0, at least-3.5, at least at least-4.0, or at least-4.5 is observed. In some embodiments, the reduction in maximum log 10 serum HBsAg is observed 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 days after administration of the therapeutically effective dose.

In certain embodiments, a therapeutically effective dose of the for example a modified oligonucleotides, or pharmaceutical compositions comprising same, comprises a dose that reduces a level of HbsAg in serum of the subject by at least 5%, at least 10%, at least 20%, at least 30%, at least 40%, at least 50%, at least 60%, at least 70%, at least 80%, at least 90%, at least 95%, or at least 99%. In some embodiments, the reduction in serum HBsAg is observed 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 days after administration of the therapeutically effective dose.

In certain embodiments, a therapeutically effective dose of the for example a modified oligonucleotides, or pharmaceutical compositions comprising same, comprises a dose at which a maximum log 10 serum HBeAg reduction of at least-0.2, at least-0.3, at least-0.4, at least-0.5, at least-0.7, at least-1.0. at least-1.5, at least-2.0, at least-2.5, at least-3.0, at least-3.5, at least at least-4.0, or at least-4.5 is observed. In some embodiments, the reduction in maximum log 10 serum HBeAg is observed 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 days after administration of the therapeutically effective dose.

In certain embodiments, a therapeutically effective dose of the for example a modified oligonucleotides, or pharmaceutical compositions comprising same, comprises a dose that reduces a level of HbeAg in serum of the subject by at least 5%, at least 10%, at least 20%, at least 30%, at least 40%, at least 50%, at least 60%, at least 70%, at least 80%, at least 90%, at least 95%, or at least 99%. In some embodiments, the reduction in serum HBeAg is observed 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 days after administration of the therapeutically effective dose.

In certain embodiments, the modified oligonucleotides or pharmaceutical compositions comprising same are administered to a subject in a dose ranging from 10 mg to 1500 mg, 10 mg to 1000 mg, 10 mg to 900 mg, 10 mg to 800 mg, 10 mg to 700 mg, 10 mg to 600 mg, 10 mg to 500 mg, 10 mg to 400 mg, 10 mg to 300 mg, 10 mg to 200 mg, 10 mg to 100 mg, 50 mg to 1500 mg, 50 mg to 1000 mg, 50 mg to 900 mg, 50 mg to 800 mg, 50 mg to 700 mg, 50 mg to 600 mg, 50 mg to 500 mg, 50 mg to 400 mg, 50 mg to 300 mg, 50 mg to 200 mg, 50 mg to 100 mg, 100 mg to 1500 mg, 100 mg to 1000 mg, 100 mg to 900 mg, 100 mg to 800 mg, 100 mg to 700 mg, 100 mg to 600 mg, 100 mg to 500 mg, 100 mg to 400 mg, 100 mg to 300 mg, 100 mg to 200 mg, 200 mg to 1500 mg, 200 mg to 1000 mg, 200 mg to 900 mg, 200 mg to 800 mg, 200 mg to 700 mg, 200 mg to 600 mg, 200 mg to 500 mg, 200 mg to 400 mg, 200 mg to 300 mg, 300 mg to 1500 mg, 300 mg to 1000 mg, 300 mg to 900 mg, 300 mg to 800 mg, 300 mg to 700 mg, 300 mg to 600 mg, 300 mg to 500 mg, or 300 mg to 400 mg of the modified oligonucleotides. In certain embodiments, the modified oligonucleotides or pharmaceutical compositions comprising same are administered to a subject in a dose ranging from 50 mg to 1500 mg of the modified oligonucleotides. In certain embodiments, the modified oligonucleotides or pharmaceutical compositions comprising same are administered to a subject in a dose ranging from 50 mg to 1000 mg of the modified oligonucleotides. In certain embodiments, the modified oligonucleotides or pharmaceutical compositions comprising same are administered to a subject in a dose ranging from 50 mg to 700 mg of the modified oligonucleotides. In certain embodiments, the modified oligonucleotides or pharmaceutical compositions comprising same are administered to a subject in a dose ranging from 50 mg to 500 mg of the modified oligonucleotides. In certain embodiments, the modified oligonucleotides or pharmaceutical compositions comprising same are administered to a subject in a dose ranging from 50 mg to 450 mg of the modified oligonucleotides. In certain embodiments, the modified oligonucleotides or pharmaceutical compositions comprising same are administered to a subject in a dose ranging from 50 mg to 300 mg of the modified oligonucleotides. In certain embodiments, the modified oligonucleotides or pharmaceutical compositions comprising same are administered to a subject in a dose ranging from 50 mg to 200 mg of the modified oligonucleotides. In certain embodiments, the modified oligonucleotides or pharmaceutical compositions comprising same are administered to a subject in a dose ranging from 100 mg to 1500 mg of the modified oligonucleotides. In certain embodiments, the modified oligonucleotides or pharmaceutical compositions comprising same are administered to a subject in a dose ranging from 100 mg to 1000 mg of the modified oligonucleotides. In certain embodiments, the modified oligonucleotides or pharmaceutical compositions comprising same are administered to a subject in a dose ranging from 100 mg to 700 mg of the modified oligonucleotides. In certain embodiments, the modified oligonucleotides or pharmaceutical compositions comprising same are administered to a subject in a dose ranging from 100 mg to 500 mg of the modified oligonucleotides. In certain embodiments, the modified oligonucleotides or pharmaceutical compositions comprising same are administered to a subject in a dose ranging from 100 mg to 450 mg of the modified oligonucleotides. In certain embodiments, the modified oligonucleotides or pharmaceutical compositions comprising same are administered to a subject in a dose ranging from 100 mg to 300 mg of the modified oligonucleotides. In certain embodiments, the modified oligonucleotides or pharmaceutical compositions comprising same are administered to a subject in a dose ranging from 100 mg to 200 mg of the modified oligonucleotides.

In certain embodiments, the modified oligonucleotides or pharmaceutical compositions comprising same are administered at a dose ranging from 0.01 mg/kg to 30.0 mg/kg, 0.01 mg/kg to 27.0 mg/kg, 0.01 mg/kg to 25.0 mg/kg, 0.01 mg/kg to 22.0 mg/kg, 0.01 mg/kg to 20.0 mg/kg, 0.01 0.01 mg/kg to 15.0 mg/kg, 0.01 mg/kg to 10.0 mg/kg, 0.01 mg/kg to 8.0 mg/kg, 0.01 mg/kg to 5.0 mg/kg, 0.01 mg/kg to 4.0 mg/kg, 0.01 mg/kg to 3.0 mg/kg, 0.01 mg/kg to 2.0 mg/kg, 0.01 mg/kg to 1.0 mg/kg, 0.01 mg/kg to 0.5 mg/kg, 0.01 mg/kg to 0.1 mg/kg, 0.1 mg/kg to 30.0 mg/kg, 0.1 mg/kg to 27.0 mg/kg, 0.1 mg/kg to 25.0 mg/kg, 0.1 mg/kg to 22.0 mg/kg, 0.1 mg/kg to 20.0 mg/kg, 0.1 mg/kg to 18.0 mg/kg, 0.1 mg/kg to 15.0 mg/kg, 0.1 mg/kg to 12.0 mg/kg, 0.1 mg/kg to 10.0 mg/kg, 0.1 mg/kg to 8.0 mg/kg, 0.1 mg/kg to 5.0 mg/kg, 0.1 mg/kg to 4.0 mg/kg, 0.1 mg/kg to 3.0 mg/kg, 0.1 mg/kg to 2.0 mg/kg, 0.1 mg/kg to 1.0 mg/kg, 0.1 mg/kg to 0.5 mg/kg, 1.0 mg/kg to 30.0 mg/kg, 1.0 mg/kg to 27.0 mg/kg, 1.0 mg/kg to 25.0 mg/kg, 1.0 mg/kg to 22.0 mg/kg, 1.0 mg/kg to 20.0 mg/kg, 1.0 mg/kg to 18.0 mg/kg, 1.0 mg/kg to 15.0 mg/kg, 1.0 mg/kg to 12.0 mg/kg, 1.0 mg/kg to 10.0 mg/kg, 1.0 mg/kg to 8.0 mg/kg, 1.0 mg/kg to 5.0 mg/kg, 1.0 mg/kg to 4.0 mg/kg, 1.0 mg/kg to 3.0 mg/kg, 1.0 mg/kg to 2.0 mg/kg, 5.0 mg/kg to 30.0 mg/kg, 5.0 mg/kg to 27.0 mg/kg, 5.0 mg/kg to 25.0 mg/kg, 5.0 mg/kg to 22.0 mg/kg, 5.0 mg/kg to 20.0 mg/kg, 5.0 mg/kg to 18.0 mg/kg, 5.0 mg/kg to 15.0 mg/kg, 5.0 mg/kg to 10.0 mg/kg, 5.0 mg/kg to 7.0 mg/kg, 10.0 mg/kg to 30.0 mg/kg, 10.0 mg/kg to 27.0 mg/kg, 10.0 mg/kg to 25.0 mg/kg, 10.0 mg/kg to 22.0 mg/kg, 10.0 mg/kg to 20.0 mg/kg, 10.0 mg/kg to 18.0 mg/kg, 10.0 mg/kg to 15.0 mg/kg, 15.0 mg/kg to 30.0 mg/kg, 15.0 mg/kg to 25.0 mg/kg, 15.0 mg/kg to 20.0 mg/kg, 20 mg/kg to 30 mg/kg or 25 mg/kg to 30 mg/kg of the modified oligonucleotides. In certain embodiments, the modified oligonucleotides or pharmaceutical compositions comprising same are administered at a dose ranging from 0.01 mg/kg to 30 mg/kg of the modified oligonucleotides. In certain embodiments, the modified oligonucleotides or pharmaceutical compositions comprising same are administered at a dose ranging from 0.1 mg/kg to 25 mg/kg of the modified oligonucleotides. In certain embodiments, the modified oligonucleotides or pharmaceutical compositions comprising same are administered at a dose ranging from 1.0 mg/kg to 20 mg/kg of the modified oligonucleotides. In certain embodiments, the modified oligonucleotides or pharmaceutical compositions comprising same are administered at a dose ranging from 5.0 mg/kg to 20 mg/kg of the modified oligonucleotides. In certain embodiments, the modified oligonucleotides or pharmaceutical compositions comprising same are administered at a dose ranging from 1.0 mg/kg to 15 mg/kg of the modified oligonucleotides. In certain embodiments, the modified oligonucleotides or pharmaceutical compositions comprising same are administered at a dose ranging from 1.0 mg/kg to 5.0 mg/kg of the modified oligonucleotides.

In certain embodiments, the modified oligonucleotides or pharmaceutical compositions comprising same are administered to a subject daily, every 2 days, every 3 days, every 4 days, every 5 days, every 6 days, every 7 days, every 8 days, every 9 days, every 10 days, every 11 days, every 12 days, every 13 days, every 2 weeks, every 3 weeks, every 4 weeks, every 5 weeks, every 6 weeks, every 7 weeks, every 8 weeks, every 9 weeks, every 10 weeks, every 11 weeks, every 12 weeks, every 13 weeks, every 2 months, every 3 months or every 4 months.

In certain embodiments, the modified oligonucleotides or pharmaceutical compositions comprising same are administered to a subject daily, every 2 days, every 3 days, every 4 days, every 5 days, every 6 days, every 7 days, every 8 days, every 9 days, every 10 days, every two weeks, every three weeks or monthly.

In certain embodiments, the modified oligonucleotides or pharmaceutical compositions comprising same are administered to a subject for at least 1 week, at least 2 weeks, at least 3 weeks, at least 1 month, at least 2 months, at least 3 months, at least 4 months, at least 5 months, at least 6 months, at least 7 months, at least 8 months, at least 9 months, at least 10 months, at least 11 months, at least 1 year, at least 1.5 years, at least 2 years, at least 3 years, at least 4 years, or at least 5 years.

In certain embodiments, modified oligonucleotides or pharmaceutical compositions comprising same are administered to the subject until a specific outcome is achieved, for example the level of HBsAg and/or HbeAg in the serum of the subject is reduced. In certain embodiments, administration of the modified oligonucleotides or pharmaceutical compositions comprising same to the subject continues until the HBsAg and/or HbeAg in the serum of the subject is reduced by at least 5%, 10%, 20%, 30%, 40%, 50%, 60%, 70%, 80%, 90%, 95% or 99% compared to before the administration of the modified oligonucleotides or pharmaceutical compositions comprising same.

In certain embodiments, the modified oligonucleotides or pharmaceutical compositions comprising same are administered to a subject once a day, twice a day, three times a day or four times a day.

In certain embodiments, the modified oligonucleotides or pharmaceutical compositions comprising same are administered to a subject every day. In certain embodiments, the modified oligonucleotides or pharmaceutical compositions comprising same are administered to a subject every two days. In certain embodiments, the modified oligonucleotides or pharmaceutical compositions comprising same are administered to a subject every three days. In certain embodiments, the modified oligonucleotides or pharmaceutical compositions comprising same are administered to a subject every four days. In certain embodiments, the modified oligonucleotides or pharmaceutical compositions comprising same are administered to a subject every five days. In certain embodiments, t the modified oligonucleotides or pharmaceutical compositions comprising same are administered to a subject every six days. In certain embodiments, the modified oligonucleotides or pharmaceutical compositions comprising same are administered to a subject every seven days. In certain embodiments, the modified oligonucleotides or pharmaceutical compositions comprising same are administered to a subject every eight days. In certain embodiments, the modified oligonucleotides or pharmaceutical compositions comprising same are administered to a subject every nine days. In certain embodiments, the r the modified oligonucleotides or pharmaceutical compositions comprising same are administered to a subject every ten days. In certain embodiments, the modified oligonucleotides or pharmaceutical compositions comprising same are administered to a subject every eleven days. In certain embodiments, the modified oligonucleotides or pharmaceutical compositions comprising same are administered to a subject every twelve days. In certain embodiments, the modified oligonucleotides or pharmaceutical compositions comprising same are administered to a subject every thirteen days. In certain embodiments, the modified oligonucleotides or pharmaceutical compositions comprising same are administered to a subject every two weeks. In certain embodiments, the modified oligonucleotides or pharmaceutical compositions comprising same are administered to a subject every three weeks. In certain embodiments, the modified oligonucleotides or pharmaceutical compositions comprising same are administered to a subject every month. In certain embodiments, the modified oligonucleotides or pharmaceutical compositions comprising same are administered to a subject every 2 months. In certain embodiments, the modified oligonucleotides or pharmaceutical compositions comprising same are administered to a subject every 3 months. In certain embodiments, the modified oligonucleotides or pharmaceutical compositions comprising same are administered to a subject every 4 months. In certain embodiments, the modified oligonucleotides or pharmaceutical compositions comprising same are administered to a subject every 5 months. In certain embodiments, the modified oligonucleotides or pharmaceutical compositions comprising same are administered to a subject every 6 months. In certain embodiments, the modified oligonucleotides or pharmaceutical compositions comprising same are administered to a subject two or more times a year. In certain embodiments, the modified oligonucleotides or pharmaceutical compositions comprising same are administered to a subject two or more times every two years. In certain embodiments, the modified oligonucleotides or pharmaceutical compositions comprising same are administered to a subject two or more times every two or more years.

In certain embodiments, the modified oligonucleotides or pharmaceutical compositions comprising same are administered to a subject once every 1-30 days. In certain embodiments, the modified oligonucleotides or pharmaceutical compositions comprising same are administered to a subject once every 1-22 days. In certain embodiments, the modified oligonucleotides or pharmaceutical compositions comprising same are administered to a subject once every 1-15 days. In certain embodiments, the modified oligonucleotides or pharmaceutical compositions comprising same are administered to a subject once every 1-8 days. In certain embodiments, the modified oligonucleotides or pharmaceutical compositions comprising same are administered to a subject once every 1-5 days. In certain embodiments, the modified oligonucleotides or pharmaceutical compositions comprising same are administered to a subject once every 1-4 days. In certain embodiments, the modified oligonucleotides or pharmaceutical compositions comprising same are administered to a subject once every 1-3 days. In certain embodiments, the modified oligonucleotides or pharmaceutical compositions comprising same are administered to a subject once every 10-20 days. In certain embodiments, the modified oligonucleotides or pharmaceutical compositions comprising same are administered to a subject once every 5-15 days. In certain embodiments, the modified oligonucleotides or pharmaceutical compositions comprising same are administered to a subject once every 15-30 days.

In certain embodiments, the modified oligonucleotides or pharmaceutical compositions comprising same are administered at least once every 36 hours. In certain embodiments, t the modified oligonucleotides or pharmaceutical compositions comprising same are administered at least once every 48 hours. In certain embodiments, the modified oligonucleotides or pharmaceutical compositions comprising same are administered at least once every 60 hours. In certain embodiments, the modified oligonucleotides or pharmaceutical compositions comprising same are administered at least once every 72 hours. In certain embodiments, the modified oligonucleotides or pharmaceutical compositions comprising same are administered at least once every 84 hours. In certain embodiments, t the modified oligonucleotides or pharmaceutical compositions comprising same are administered at least once every 96 hours. In certain embodiments, the modified oligonucleotides or pharmaceutical compositions comprising same are administered at least once every 5 days. In certain embodiments, the modified oligonucleotides or pharmaceutical compositions comprising same are administered at least once every 6 days. In certain embodiments, the modified oligonucleotides or pharmaceutical compositions comprising same are administered at least once every 7 days. In certain embodiments, the modified oligonucleotides or pharmaceutical compositions comprising same are administered at least once every 8-10 days. In certain embodiments, the modified oligonucleotides or pharmaceutical compositions comprising same are administered at least once every 10-12 days. In certain embodiments, the modified oligonucleotides or pharmaceutical compositions comprising same are administered at least once every 12-15 days. In certain embodiments, the modified oligonucleotides or pharmaceutical compositions comprising same are administered at least once every 15-25 days. In certain embodiments, the modified oligonucleotides or pharmaceutical compositions comprising same are administered at least once every 20-30 days.

In some embodiments, administration of the modified oligonucleotides or pharmaceutical compositions comprising same comprises a dosing holiday. For example, the modified oligonucleotides or pharmaceutical compositions comprising same are administered to the subject every three days, followed by a week, two weeks, three weeks or a month with no administration, followed by a resumption of dosing. The person of ordinary skill in the art will understand that this dosing holiday is exemplary. Dosing holidays of other duration and frequency are contemplated as within the scope of the instant disclosure. As a further example, the modified oligonucleotides or pharmaceutical compositions comprising same may be administered to the subject until levels of HBsAg or HbeAg fall below a certain threshold, or no HBV infection is detected in the subject, followed by a dosing holiday, and resumption of dosing if HBsAg or HbeAg in the serum of the subject is again detected.

In certain embodiments, a single one time dose of the modified oligonucleotides or pharmaceutical compositions comprising same is administered to a subject. In other embodiments, multiple doses of the modified oligonucleotides or pharmaceutical compositions comprising same are administered to the subject.

In certain embodiments, administration of the modified oligonucleotides or pharmaceutical compositions comprising same can comprise a dosing schedule in which the modified oligonucleotides or pharmaceutical compositions comprising same are administered more frequently initially, followed by less frequent doses. Such a dosing schedule has the advantage in that it can be used to maintain a steady state liver concentration of the modified oligonucleotides described herein. For example, if the liver half-life of the modified oligonucleotide is 3-4 weeks, an initial dosing schedule comprising loading doses on days 1 and 4, followed by weekly maintenance doses starting on day 8 (e.g., day 8, 15 and 22 etc.) can be used to achieve a steady state liver concentration of the modified oligos of the disclosure.

In certain embodiments, administration of the modified oligonucleotides or pharmaceutical compositions comprising same comprises a loading dose, followed by a loading maintenance dose.

The term "loading dose" refers to one or more doses of the modified oligonucleotides or pharmaceutical compositions that are administered in addition to a dosage regimen, or that are higher than the remaining doses in the dosing regimen. As used herein a "loading dose" may refer to one or more doses of the modified oligonucleotides or pharmaceutical compositions which are the same concentration or a lower concentration (if administered in addition to the regular dosage regimen), or a higher concentration than the doses of the modified oligonucleotides or pharmaceutical compositions that are administered as part of a dosage regimen (if administered in place of the regular dosage regimen). Loading doses may also be administered more frequently than maintenance doses in a dosing regimen.

The term "maintenance dose" as used herein refers to the repeated, regular administration of a therapeutic agent. The maintenance dose as used herein does not include a loading dose, which may, in some embodiments, be administered in addition, e.g., prior, to the maintenance dose.

In an exemplary dosing regimen comprising a loading dose and a maintenance dose, the modified oligonucleotides or pharmaceutical compositions are administered at a higher loading dose, followed by a lower maintenance dose. For example, the loading dose can be about 1.1×, 1.2×, 1.3×, 1.4×, 1.5×, 1.6×, 1.7×, 1.8×, 1.9×, 2.0×, 2.1×, 2.2×, 2.3×, 2.4×, 2.5×, 3.0×, 3.5×, 4.0×, 4.5× or 5× higher than the maintenance dose. Alternatively, or in addition, the loading dose can be administered more frequently than the maintenance dose. For example, the loading dose can be administered every day, every 2 days, every 3 days, every 4 days, or every 5 days, for at least 1, 2, 3, 4 or 5 doses, followed by a maintenance dose every week, every 10 days, every 14 days and the like. The skilled artisan will appreciate that, should the need arise, a subject who has been dosed according to the maintenance dosing schedule can be dosed again with the loading dose or doses. As a further exemplary dosing schedule, a subject can be administered loading doses on days 1 and 4, followed by weekly maintenance doses on day 8.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments antisense oligonucleotides targeted to a HBV nucleic acid may be shortened or truncated. For example, a single subunit may be deleted from the 5' end (5' truncation), or alternatively from the 3' end (3' truncation). A shortened or truncated antisense compound targeted to a HBV nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al. *Natl. Cancer Inst.* 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (*Nuc. Acid. Res.* 16:3341-3358,1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Antisense Compound Motifs

In certain embodiments, antisense compounds targeted to a HBV nucleic acid have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may optionally serve as a substrate for the cellular endonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE and 2'-O—CH$_3$, among others), and bicyclic sugar modified nucleosides (such bicyclic sugar modified nucleosides may include those having a constrained ethyl). In certain embodiments, nucleosides in the wings may include several modified sugar moieties, including, for example 2'-MOE and bicyclic sugar moieties such as constrained ethyl or LNA. In certain embodiments, wings may include several modified and unmodified sugar moieties. In certain embodiments, wings may include various combinations of 2'-MOE nucleosides, bicyclic sugar moieties such as constrained ethyl nucleosides or LNA nucleosides, and 2'-deoxynucleosides.

Each distinct region may comprise uniform sugar moieties, variant, or alternating sugar moieties. The wing-gap-wing motif is frequently described as "X—Y—Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X—Y—Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same; in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

Target Nucleic Acids, Target Regions and Nucleotide Sequences

In certain embodiments, nucleotide sequences that encode HBV include, without limitation, the following: GENBANK Accession U95551.1 (incorporated herein as SEQ ID NO: 1).

It is understood that the sequence set forth in each SEQ ID NO in the Examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase.

In certain embodiments, a target region is a structurally defined region of the target nucleic acid. For example, a target region may encompass a 3' UTR, a 5' UTR, an exon, an intron, an exon/intron junction, a coding region, a translation initiation region, translation termination region, or other defined nucleic acid region. The structurally defined regions for HBV can be obtained by accession number from sequence databases such as NCBI and such information is incorporated herein by reference. In certain embodiments, a target region may encompass the sequence from a 5' target site of one target segment within the target region to a 3' target site of another target segment within the same target region.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region may contain one or more target segments. Multiple target segments within a target region may be overlapping. Alternatively, they may be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments may be found within a 5' UTR, a coding region, a 3' UTR, an intron, an exon, or an exon/intron junction. Target segments containing a start codon or a stop codon are also suitable target segments. A suitable target segment may specifically exclude a certain structurally defined region such as the start codon or stop codon.

The determination of suitable target segments may include a comparison of the sequence of a target nucleic acid to other sequences throughout the genome. For example, the BLAST algorithm may be used to identify regions of similarity amongst different nucleic acids. This comparison can prevent the selection of antisense compound sequences that may hybridize in a non-specific manner to sequences other than a selected target nucleic acid (i.e., non-target or off-target sequences).

There may be variation in activity (e.g., as defined by percent reduction of target nucleic acid levels) of the antisense compounds within an active target region. In certain embodiments, reductions in HBV mRNA levels are indicative of inhibition of HBV expression. Reductions in levels of a HBV protein are also indicative of inhibition of target mRNA expression. Further, phenotypic changes are indicative of inhibition of HBV expression. In certain embodiments, reduced fatigue, reduced flu-like symptoms, increase in appetite, reduced nausea, reduced joint pain, reduced jaundice, reduced pain in the abdomen, reduced weakness, reduced weight loss, reduction in breast enlargement in men, reduced rash on the palms, reduced difficulty with blood clotting, reduced cirrhosis, reduced spider-like blood vessels on the skin, increased Vitamins A and D absorption, reduced tumor growth, reduced tumor volume, reduced headache, reduced fever, reduced diarrhea, reduced pain over the liver area of the body, reduced clay- or grey-colored stool, reduced itching, reduced dark-colored urine, and reduced nausea and vomiting can be indicative of inhibition of HBV expression, In certain embodiments, amelioration of symptoms associated with HBV-related conditions, disease, and disorders can be indicative of inhibition of HBV expression. In certain embodiments, reduction of cirrhosis is indicative of inhibition of HBV expression. In certain embodiments, reduction of liver cancer markers can be indicative of inhibition of HBV expression.

Hybridization

In some embodiments, hybridization occurs between an antisense compound disclosed herein and a HBV nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a HBV nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a HBV nucleic acid).

Non-complementary nucleobases between an antisense compound and a HBV nucleic acid may be tolerated provided that the antisense compound remains able to specifically hybridize to a target nucleic acid. Moreover, an antisense compound may hybridize over one or more segments of a HBV nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a HBV nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.,* 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a HBV nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a HBV nucleic acid, or specified portion thereof. In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a HBV nucleic acid, or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

As used herein, "complementary" polynucleotides are those that are capable of base pairing according to the standard Watson-Crick complementarity rules. Specifically, purines will base pair with pyrimidines to form a combination of guanine paired with cytosine (G: C) and adenine paired with either thymine (A: T) in the case of DNA, or adenine paired with uracil (A: U) in the case of RNA. For example, the sequence "A-G-T" binds to the complementary sequence "T-C-A." It is understood that two polynucleotides may hybridize to each other even if they are not completely complementary to each other, provided that each has at least one region that is substantially complementary to the other.

As used herein, the terms "substantially complementary" or "partially complementary" mean that two nucleic acid sequences are complementary at least at about 50%, 60%, 70%, 80% or 90% of their nucleotides.

In some embodiments, the two nucleic acid sequences can be complementary at least at 85%, 90%, 95%, 96%, 97%, 98%, 99% or more of their nucleotides. In some embodiments, the two nucleic acid sequences can be between 60% to 100% complementary, between 70% to 100% complementary, between 80% and 100% complementary, between 90% and 100% complementary, between 60% to 90% complementary, between 60% to 80% complementary, between 60% and 70% complementary, between 70% and 90% complementary, between 70% and 80% complementary, between 80% and 100% complementary, or between 80% and 90% complementary.

The terms "substantially complementary" and "partially complementary" can also mean that two nucleic acid sequences can hybridize under high stringency conditions, and such conditions are well known in the art.

As used herein, the term "identity" means that sequences are compared with one another as follows. In order to determine the percentage identity of two nucleic acid sequences, the sequences can first be aligned with respect to one another in order subsequently to make a comparison of these sequences possible. For this e.g. gaps can be inserted into the sequence of the first nucleic acid sequence and the nucleotides can be compared with the corresponding position of the second nucleic acid sequence. If a position in the first nucleic acid sequence is occupied by the same nucleotide as is the case at a position in the second sequence, the two sequences are identical at this position. The percentage identity between two sequences is a function of the number of identical positions divided by the number of all positions compared in the sequences investigated.

A "percent identity" for aligned segments of a test sequence and a reference sequence is the percent of identical components which are shared by the two aligned sequences divided by the total number of components in reference sequence segment, i.e., the entire reference sequence or a smaller defined part of the reference sequence.

The percentage identity of two sequences can be determined with the aid of a mathematical algorithm. A preferred, but not limiting, example of a mathematical algorithm which can be used for comparison of two sequences is the algorithm of Karlin et al. (1993), PNAS USA, 90:5873-5877. Such an algorithm is integrated in the NBLAST program, with which sequences which have a desired identity to the sequences of the present invention can be identified. In order to obtain a gapped alignment, as described here, the "Gapped BLAST" program can be used, as is described in Altschul et al. (1997), Nucleic Acids Res, 25:3389-3402. If BLAST and Gapped BLAST programs are used, the preset parameters of the particular program (e.g. NBLAST) can be used. The sequences can be aligned further using version 9 of GAP (global alignment program) of the "Genetic Computing Group" using the preset (BLOSUM62) matrix (values −4 to +11) with a gap open penalty of −12 (for the first zero of a gap) and a gap extension penalty of −4 (for each additional successive zero in the gap). After the alignment, the percentage identity is calculated by expressing the number of agreements as a percentage content of the nucleic acids in the sequence claimed. The methods described for determination of the percentage identity of two nucleic acid sequences can also be used correspondingly, if necessary, on the coded amino acid sequences.

Useful methods for determining sequence identity are also disclosed in Guide to Huge Computers (Martin J. Bishop, ed., Academic Press, San Diego (1994)), and Carillo, H., and Lipton, D., (Applied Math48: 1073 (1988)). More particularly, preferred computer programs for determining sequence identity include but are not limited to the Basic Local Alignment Search Tool (BLAST) programs which are publicly available from National Center Biotechnology Information (NCBI) at the National Library of Medicine, National Institute of Health, Bethesda, Md. 20894; see BLAST Manual, Altschul et al., NCBI, NLM, NIH; (Altschul et al., J. Mol. Biol. 215:403-410 (1990)); version 2.0 or higher of BLAST programs allows the introduction of gaps (deletions and insertions) into alignments; for peptide sequence BLASTX can be used to determine sequence identity; and, for polynucleotide sequence BLASTN can be used to determine sequence identity. Percent identity can be 70% identity or greater, e.g., at least 70% identity, at least 75% identity, at least 80% identity, at least 85% identity, at least 90% identity, at least 95% identity, at least 98% identity, at least 99% identity or 100% identity.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a HBV nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds provided herein can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise a chemically modified ribofuranose ring moiety. Examples of chemically modified ribofuranose rings include, without limitation, addition of substituent groups (including 5' and 2' substituent groups); bridging of non-geminal ring atoms to form bicyclic nucleic acids (BNA); replacement of the ribosyl ring oxygen atom with S, N(R), or $C(R^1)(R^2)$ (R=H, $C_1$-$C_{12}$ alkyl or a protecting group); and combinations thereof. Examples of chemically modified sugars include, 2'-F-5'-methyl substituted nucleoside (see, PCT International Application WO 2008/101157, published on Aug. 21, 2008 for other disclosed 5', 2'-bis substituted nucleosides), replacement of the ribosyl ring oxygen atom with S with further substitution at the 2'-position (see, published U.S. Patent Application US2005/0130923, published on Jun. 16, 2005), or, alternatively, 5'-substitution of a BNA (see, PCT International Application WO 2007/134181, published on Nov. 22, 2007, wherein LNA is substituted with, for example, a 5'-methyl or a 5'-vinyl group).

Examples of nucleosides having modified sugar moieties include, without limitation, nucleosides comprising 5'-vinyl, 5'-methyl (R or S), 4'-S, 2'-F, 2'—$OCH_3$, and 2'-O$(CH_2)_2OCH_3$ substituent groups. The substituent at the 2' position can also be selected from allyl, amino, azido, thio, O-allyl, O—$C_1$-$C_{10}$ alkyl, $OCF_3$, O$(CH_2)_2SCH_3$, O$(CH_2)_2$—O—N(R''')(R''), and O—$CH_2$—C(=O)—N(R''') (R''), where each R''' and R'' is, independently, H or substituted or unsubstituted $C_1$-$C_{10}$ alkyl.

As used herein, "bicyclic nucleosides" refer to modified nucleosides comprising a bicyclic sugar moiety. Examples of bicyclic nucleosides include, without limitation, nucleosides comprising a bridge between the 4' and the 2' ribosyl ring atoms. In certain embodiments, antisense compounds provided herein include one or more bicyclic nucleosides wherein the bridge comprises a 4' to 2' bicyclic nucleoside. Examples of such 4' to 2' bicyclic nucleosides, include, but are not limited to, one of the formulae: 4'-$(CH_2)$—O-2' (LNA); 4'-$(CH_2)$—S-2; 4'—$(CH_2)_2$—O-2' (ENA); 4'-CH $(CH_3)$—O-2' (cEt) and 4'-CH$(CH_2OCH_3)$—O-2', and analogs thereof (see, U.S. Pat. No. 7,399,845, issued on Jul. 15, 2008); 4'-C$(CH_3)(CH_3)$—O-2', and analogs thereof (see, published PCT International Application WO2009/006478, published Jan. 8, 2009); 4'-CH$_2$—N(OCH$_3$)-2', and analogs thereof (see, published PCT International Application WO2008/150729, published Dec. 11, 2008); 4'-CH$_2$—O—N(CH$_3$)-2' (see, published U.S. Patent Application US2004/0171570, published Sep. 2, 2004); 4'-CH$_2$—N(R)—O-2', wherein R is H, C$_1$-C$_{12}$ alkyl, or a protecting group (see, U.S. Pat. No. 7,427,672, issued on Sep. 23, 2008); 4'-CH$_2$—C(H)(CH$_3$)-2' (see, Chattopadhyaya, et al., J. Org. Chem., 2009, 74, 118-134); and 4'-CH$_2$—C(═CH$_2$)-2', and analogs thereof (see, published PCT International Application WO 2008/154401, published on Dec. 8, 2008). Also see, for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 129 (26) 8362-8379 (Jul. 4, 2007); Elayadi et al., *Curr. Opinion Invens. Drugs*, 2001, 2, 558-561; Braasch et al., Chem. Biol., 2001, 8, 1-7; Orum et al., *Curr. Opinion Mol. Ther.*, 2001, 3, 239-243; U.S. Pat. Nos. 6,670,461, 7,053,207, 6,268,490, 6,770,748, 6,794, 499, 7,034, 133, 6,525,191, 7,399,845; published PCT International applications WO 2004/106356, WO 94/14226, WO 2005/021570, and WO 2007/134181; U.S. Patent Publication Nos. US2004/0171570, US2007/0287831, and US2008/0039618; and U.S. patents Ser. Nos. 12/129,154, 60/989,574, 61/026,995, 61/026,998, 61/056,564, 61/086, 231, 61/097,787, and 61/099,844; and PCT International Application Nos. PCT/US2008/064591, PCT/US2008/066154, and PCT/US2008/068922. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[C(R$^a$)(R$^b$)]$_n$—, —C(R$^a$)═C(R$^b$)—, —C(R$^a$)═N—, —C(═NR$^a$)—, —C(═O)—, —C(═S)—, —O—, —Si(R$^a$)$_2$—, —S(═O)$_x$—, and —N(R$^a$)—;

wherein:
x is 0, 1, or 2;
n is 1, 2, 3, or 4;
each R$^a$ and R$^b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$^1$, NJ$^1$J$^2$, SJ$^1$, N$_3$, COOJ$^1$, acyl (C(═O)—H), substituted acyl, CN, sulfonyl (S(═O)$_2$-J$^1$), or sulfoxyl (S(═O)-J$^1$); and
each J$^1$ and J$^2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(═O)—H), substituted acyl, a heterocycle radical, a substituted heterocycle radical, C$_1$-C$_{12}$ aminoalkyl, substituted C$_1$-C$_{12}$ aminoalkyl, or a protecting group.

In certain embodiments, the bridge of a bicyclic sugar moiety is, —[C(R$^a$)(R$^b$)]$_n$—, [C(R$^a$)(R$^b$)]$_n$—O—, —C(R$^a$)

(R$^b$)—N(R)—O— or, —C(R$^a$)(R$^b$)—O—N(R)—. In certain embodiments, the bridge is 4'-CH$_2$-2', 4'—(CH$_2$)$_2$-2', 4'—(CH$_2$)$_3$-2', 4'—CH$_2$—O-2', 4'—(CH$_2$)$_2$—O-2', 4'—CH$_2$—O—N(R)-2', and 4'-CH$_2$—N(R)—O-2'-, wherein each R is, independently, H, a protecting group, or C$_1$-C$_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNAs have been incorporated into antisense oligonucleotides that showed antisense activity (Frieden et al., *Nucleic Acids Research*, 2003, 21, 63 6563 72).

In certain embodiments, bicyclic nucleosides include, but are not limited to, (A) α-L-Methyleneoxy (4'-CH$_2$—O-2') BNA, (B) β-D-Methyleneoxy (4'-CH$_2$—O-2') BNA, (C) Ethyleneoxy (4'-(CH$_2$)$_2$—O-2') BNA, (D) Aminooxy (4'-CH$_2$—O—N(R)-2') BNA, (E) Oxyamino (4'-CH$_2$—N(R)—O-2') BNA, (F) Methyl (methyleneoxy) (4'-CH(CH$_3$)—O-2') BNA, (G) methylene- (A)

(B)

(C)

(D)

(E)

-continued (F)

(G)

(H)

(I)

(J)

thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, and (J) propylene carbocyclic (4'-(CH$_2$)$_3$-2') BNA as depicted below.

wherein Bx is the base moiety and R is, independently, H, a protecting group or C$_1$-C$_{12}$ alkyl.

In certain embodiments, the bicyclic nucleoside is according to Formula I:

I wherein:

Bx is a heterocyclic base moiety;

-Q$^a$-Q$^b$-Q$^c$- is —CH$_2$—N(R$^c$)—CH$_2$—, —C(=O)—N(R$^c$)—CH$_2$—, —CH$_2$—O—N(R$^c$)—, —CH$_2$—N(R$^c$)—O—, or —N(R$^c$)—O—CH$_2$;

R$^c$ is C$_1$-C$_{12}$ alkyl or an amino protecting group; and

T$^a$ and T$^b$ are each, independently, H, a hydroxyl protecting group, a conjugate group, a reactive phosphorus group, a phosphorus moiety, or a covalent attachment to a support medium.

In certain embodiments, bicyclic nucleoside having Formula II:

II wherein:

Bx is a heterocyclic base moiety;

T$^a$ and T$^b$ are each, independently, H, a hydroxyl protecting group, a conjugate group, a reactive phosphorus group, a phosphorus moiety, or a covalent attachment to a support medium;

Z$_a$ is C$_1$-C$_6$ alkyl, C$_2$-C$_6$ alkenyl, C$_2$-C$_6$ alkynyl, substituted C$_1$-C$_6$ alkyl, substituted C$_2$-C$_6$ alkenyl, substituted C$_2$-C$_6$ alkynyl, acyl, substituted acyl, substituted amide, thiol, or substituted thio.

In one embodiment, each of the substituted groups is, independently, mono or poly substituted with substituent groups independently selected from halogen, oxo, hydroxyl, OJ$^c$, NJ$^c$J$^d$, SJ$^c$, N$_3$, OC(=X)J$^c$, and NJ$^c$C(=X) NJ$^c$J$^d$, wherein each J$^c$, J$^d$, and J$^e$ is, independently, H, C$_1$-C$_6$ alkyl, or substituted C$_1$-C$_6$ alkyl and X is 0 or NJ$^c$.

In certain embodiments, bicyclic nucleoside having Formula III:

III wherein:

Bx is a heterocyclic base moiety;

T$^a$ and T$^b$ are each, independently, H, a hydroxyl protecting group, a conjugate group, a reactive phosphorus group, a phosphorus moiety, or a covalent attachment to a support medium;

Z$^b$ is C$_1$-C$_6$ alkyl, C$_2$-C$_6$ alkenyl, C$_2$-C$_6$ alkynyl, substituted C$_1$-C$_6$ alkyl, substituted C$_2$-C$_6$ alkenyl, substituted C$_2$-C$_6$ alkynyl, or substituted acyl (C(=O)—).

In certain embodiments, bicyclic nucleoside having Formula IV:

wherein:

Bx is a heterocyclic base moiety;

$T^a$ and $T^b$ are each, independently H, a hydroxyl protecting group, a conjugate group, a reactive phosphorus group, a phosphorus moiety, or a covalent attachment to a support medium;

$R^d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl;

each $q^a$, $q^b$, $q^c$ and $q^d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl, or substituted $C_1$-$C_6$ aminoalkyl;

In certain embodiments, bicyclic nucleoside having Formula V:

wherein:

Bx is a heterocyclic base moiety;

$T^a$ and $T^b$ are each, independently, H, a hydroxyl protecting group, a conjugate group, a reactive phosphorus group, a phosphorus moiety, or a covalent attachment to a support medium;

$q^a$, $q^b$, $q^e$ and $q^f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ^j$, $SJ^j$, $SOJ^j$, $SO_2J^j$, $NJ^jJ^k$, $N_3$, CN, C(=O) $OJ^j$, C(=O)$NJ^jJ^k$, C(=O)$J^j$, O—C(=O)$NJ^jJ^k$, N(H)C(=NH)$NJ^jJ^k$, N(H)C(=O) $NJ^jJ^k$ or N(H)C(=S)$NJ^jJ^k$;

or $q^e$ and $q^f$ together are =C($q^g$)($q^h$);

$q^g$ and $q^h$ are each, independently, H, halogen, $C_1$-$C_{12}$ alkyl, or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine, and uracil, along with their oligomerization, and nucleic acid recognition properties have been described (see, e.g., Koshkin et al., Tetrahedron, 1998, 54, 3607-3630). BNAs and preparation thereof are also described in WO 98/39352 and WO 99/14226.

Analogs of methyleneoxy (4'-$CH_2$—O-2') BNA, methyleneoxy (4'-$CH_2$—O-2') BNA, and 2'-thio-BNAs, have also been prepared (see, e.g., Kumar et al., Bioorg. Med. Chem. Lett., 1998, 8, 2219-2222). Preparation of locked nucleoside analogs comprising oligodeoxyribonucleotide duplexes as substrates for nucleic acid polymerases has also been described (see, e.g., Wengel et al., WO 99/14226). Furthermore, synthesis of 2'-amino-BNA, a novel conformationally restricted high-affinity oligonucleotide analog, has been described in the art (see, e.g., Singh et al., J. Org. Chem., 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleoside having Formula VI:

wherein:

Bx is a heterocyclic base moiety;

$T^a$ and $T^b$ are each, independently, H, a hydroxyl protecting group, a conjugate group, a reactive phosphorus group, a phosphorus moiety, or a covalent attachment to a support medium;

each $q^i$, $q^j$, $q^k$ and $q^l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ^j$, $SJ^j$, $SOJ^j$, $SO_2J^j$, $NJ^jJ^k$, $N_3$, CN, C(=O) $OJ^j$, C(=O)$NJ^jJ^k$, C(=O)$J^j$, O—C(=O)$NJ^jJ^k$, N(H)C(=NH)$NJ^jJ^k$, N(H)C(=O)$NJ^jJ^k$, or N(H)C(=S)$NJ^jJ^k$; and $q^i$ and $q^j$ or $q^l$ and $q^k$ together are =C($q^g$)($q^h$), wherein $q^g$ and $q^h$, are each, independently, H, halogen, $C_1$-$C_{12}$ alkyl, or substituted $C_1$-$C_{12}$ alkyl.

One carbocyclic bicyclic nucleoside having a 4'-(CH$_2$)$_3$-2' bridge and the alkenyl analog, bridge 4'—CH=CH—CH$_2$-2', have been described (see, e.g., Freier et al., Nucleic Acids Research, 1997, 25 (22), 44294443 and Albaek et al., J. Org. Chem., 2006, 71, 7731-7740). The synthesis and preparation of carbocyclic bicyclic nucleosides along with their oligomerization and biochemical studies have also been described (see, e.g., Srivastava et al., J. Am. Chem. Soc. 2007, 129 (26), 8362-8379).

As used herein, "bicyclic nucleoside" refers to a nucleoside comprising a bridge connecting two carbon atoms of the sugar ring, thereby forming a bicyclic sugar moiety. In certain embodiments, the bridge connects the 2' carbon and another carbon of the sugar ring.

As used herein, "4'-2' bicyclic nucleoside" or "4' to 2' bicyclic nucleoside" refers to a bicyclic nucleoside comprising a furanose ring comprising a bridge connecting the 2' carbon atom and the 4' carbon atom.

As used herein, "monocyclic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: $O[(CH_2)$, $O]_mCH_3$, $O(CH_2)_nNH_2$, $O(CH_2)$, $CH_3$, $O(CH_2)_nONH_2$, $OCH_2C(=O)$ $N(H)$ $CH_3$, and $O(CH_2)_nON[(CH_2)$, $CH_3]_2$, where n and m are from 1 to about 10. Other 2'-substituent groups can also be selected from: $C_1$-$C_{12}$ alkyl; substituted alkyl; alkenyl; alkynyl; alkaryl; aralkyl; O-alkaryl or O-aralkyl; SH; $SCH_3$; OCN; Cl; Br; CN; $CF_3$; $OCF_3$; $SOCH_3$; $SO_2CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a reporter group; an intercalator; a group for improving pharmacokinetic properties; and a group for improving the pharmacodynamic properties of an antisense compound, and other substituents having similar properties. In certain embodiments, modified nucleosides comprise a 2'-MOE side chain (see, e.g., Baker et al., J. Biol. Chem., 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (see, e.g., Martin, P., *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), mannitol nucleic acid (MNA) (see Leumann, CJ. *Bioorg. & Med. Chem.* (2002) 10:841-854), fluoro HNA (F-HNA), or those compounds having Formula X: wherein independently for each of said at least one tetrahydropyran nucleoside analog of Formula X:

Bx is a heterocyclic base moiety;

$T^3$ and $T^4$ are each, independently, an internucleoside linking group linking the tetrahydropyran nucleoside analog to the antisense compound or one of $T^3$ and $T^4$ is an internucleoside linking group linking the tetrahydropyran nucleoside analog to the antisense compound and the other of $T^3$ and $T^4$ is H, a hydroxyl protecting group, a linked conjugate group, or a 5' or 3'-terminal group;

$q^1$, $q^2$, $q^3$, $q^4$, $q^5$, $q^6$, and $q^7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and one of $R^1$ and $R^2$ is hydrogen and the other is selected from halogen, substituted or unsubstituted alkoxy, $NJ^1J^2$, $SJ^1$, $N_3$, $OC(=X)$ $J^1$, $OC(=X)$ $NJ^1J^2$, $NJ^3C$ $(=X)$ $NJ^1J^2$, and CN, wherein X is O, S, or $NJ^1$, and each $J^1$, $J^2$, and $J^3$ is, independently, H or $C_1$-$C_6$ alkyl.

In certain embodiments, the modified THP nucleosides of Formula X are provided wherein $q^m$, $q^n$, $q^p$, $q^r$, $q^s$, $q^t$, and $q^u$ are each H. In certain embodiments, at least one of $q^m$, $q^n$, $q^p$, $q^r$, $q^s$, $q^t$, and $q^u$ is other than H. In certain embodiments, at least one of $q^m$, $q^n$, $q^p$, $q^r$, $q^s$, $q^t$, and $q^u$ is methyl. In certain embodiments, THP nucleosides of Formula X are provided wherein one of $R^1$ and $R^2$ is F. In certain embodiments, $R^1$ is fluoro and $R^2$ is H, $R^1$ is methoxy and $R^2$ is H, and $R^1$ is methoxyethoxy and $R^2$ is H.

As used herein, "2'-modified nucleoside" or "2'-substituted nucleoside" refers to a nucleoside comprising a sugar comprising a substituent at the 2' position of a furanose ring other than H or OH. 2'-modified nucleosides, include, but are not limited to, bicyclic nucleosides wherein the bridge connecting two carbon atoms of the sugar ring connects the 2' carbon and another carbon of the sugar ring and nucleosides with non-bridging 2'-substituents, such as allyl, amino, azido, thio, O-allyl, $O$—$C_1$-$C_{10}$ alkyl, —$OCF_3$, $O$—$(CH_2)_2$—$OCH_3$, 2'-$O(CH_2)_2SCH_3$, $O$—$(CH_2)_2$—$O$—$N$ $(R^m)(R^n)$, or $O$—$CH_2$—$C(=O)$—$N(R^m)(R^n)$, where each $R^m$ and $R^n$ is, independently, H or substituted or unsubstituted $C_1$-$C_{10}$ alkyl. 2'-modified nucleosides may further comprise other modifications, for example, at other positions of the sugar and/or at the nucleobase.

As used herein, "2'-F" refers to a sugar comprising a fluoro group at the 2' position.

As used herein, "2'-OMe" or "2'—$OCH_3$" or "2'-O-methyl" each refers to a nucleoside comprising a sugar comprising an —$OCH_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see, e.g., review article: Leumann, J. C, *Bioorganic & Medicinal Chemistry*, 2002, 10, 841-854). Such ring systems can undergo various additional substitutions to enhance activity.

Methods for the preparations of modified sugars are well known to those skilled in the art.

In nucleotides having modified sugar moieties, the nucleobase moieties (natural, modified, or a combination thereof) are maintained for hybridization with an appropriate nucleic acid target.

In certain embodiments, antisense compounds comprise one or more nucleotides having modified sugar moieties. In certain embodiments, the modified sugar moiety is 2'-MOE. In certain embodiments, the 2'-MOE modified nucleotides are arranged in a gapmer motif. In certain embodiments, the modified sugar moiety is a cEt. In certain embodiments, the cEt modified nucleotides are arranged throughout the wings of a gapmer motif.

Compositions and Methods for Formulating Pharmaceutical Compositions

Antisense oligonucleotides may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

An antisense compound targeted to a HBV nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, in one embodiment, employed in the methods described herein is a pharmaceutical composition comprising an antisense compound targeted to a HBV nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

The disclosure provides pharmaceutical compositions comprising the modified oligonucleotides of the disclosure and a pharmaceutically acceptable carrier, diluent or excipient. In some embodiments, the modified oligonucleotide comprises a sequence of any one SEQ ID NOS: 11-666. In some embodiments, the modified oligonucleotide comprises a sequence of any one SEQ ID NOS: 11-666, and 1, 2, 3, 4, or 5 modifications thereto, as described herein.

Modified oligonucleotides may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

The pharmaceutical compositions of the disclosure can optionally comprise therapeutic agents, pharmaceutical agents, carriers, adjuvants, dispersing agents, diluents, and the like.

An antisense compound targeted to a HBV nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally.

Accordingly, in one embodiment, employed in the methods described herein is a pharmaceutical composition comprising an antisense compound targeted to a HBV nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising modified oligonucleotides can encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

Modified oligonucleotides formulated as prodrugs are contemplated as within the scope of the instant disclosure. A prodrug can include the incorporation of additional nucleosides at one or both ends of an antisense compound which are cleaved by endogenous nucleases within the body, to form the active antisense compound.

Pharmaceutical compositions can contain any of the reagents discussed above, and one or more of a pharmaceutically acceptable carrier, a diluent or an excipient.

A "pharmaceutical composition" is a formulation comprising the modified oligonucleotides described herein, in a form suitable for administration to a subject. In certain embodiments, the pharmaceutical composition is in bulk or in unit dosage form. The unit dosage form is any of a variety of forms, including, for example, a capsule, an IV bag, a tablet, a single use injector, a single pump on an aerosol inhaler or a vial. The quantity of active ingredient (e.g., a formulation of the modified oligonucleotide) in a unit dose of composition is an effective amount and is varied according to the particular treatment involved. One skilled in the art will appreciate that it is sometimes necessary to make routine variations to the dosage depending on the age and condition of the patient. The dosage will also depend on the route of administration. A variety of routes are contemplated, including oral, pulmonary, rectal, parenteral, transdermal, subcutaneous, intravenous, intramuscular, intraperitoneal, inhalational, buccal, sublingual, intrapleural, intrathecal, intranasal, and the like. Dosage forms for the topical or transdermal administration of a of this invention include powders, sprays, ointments, pastes, creams, lotions, gels, solutions, patches and inhalants. In certain embodiments, the modified oligonucleotide is mixed under sterile conditions with a pharmaceutically acceptable carrier, and with any preservatives, buffers, or propellants that are required.

"Pharmaceutically acceptable excipient" means an excipient that is useful in preparing a pharmaceutical composition that is generally safe, non-toxic and neither biologically nor otherwise undesirable, and includes excipient that is acceptable for veterinary use as well as human pharmaceutical use. A "pharmaceutically acceptable excipient" as used in the specification includes both one and more than one such excipient.

A pharmaceutical composition is formulated to be compatible with its intended route of administration. Examples of routes of administration include parenteral, e.g., intravenous, intradermal, subcutaneous, oral (e.g., inhalation), transdermal (topical), intraperitoneal (into the body cavity) and transmucosal administration. Solutions or suspensions used for parenteral, intradermal, intraperitoneal or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates, and agents for the adjustment of tonicity such as sodium chloride or dextrose. The pH can be adjusted with acids or bases, such as hydrochloric acid or sodium hydroxide. The parenteral or subcutaneous preparation can be enclosed in ampoules, disposable syringes or multiple dose vials made of glass or plastic. These preparations can contain anti-oxidants, buffers, bacteriostats and solutes which render the formulation isotonic with the blood of the intended recipient. Aqueous and non-aqueous sterile suspensions can include suspending agents and thickening agents. The formulations can be presented in unit/dose or multi-dose containers, for example sealed ampoules, syringes and vials, and can be stored in a freeze-dried (lyophilized) condition requiring only the addition of the sterile liquid carrier, for example, saline or water-for-injection immediately prior to use.

The pharmaceutical composition described herein may be manufactured in a manner that is generally known, e.g., by means of conventional mixing, dissolving, granulating, dragee-making, levigating, emulsifying, encapsulating, entrapping, or lyophilizing processes. Pharmaceutical compositions may be formulated in a conventional manner using one or more pharmaceutically acceptable carriers comprising excipients and/or auxiliaries that facilitate processing of the active agents into preparations that can be used pharmaceutically. Of course, the appropriate formulation is dependent upon the route of administration chosen.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion, and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol and sorbitol, and sodium chloride in the composition. Prolonged absorption of the injectable compositions can be brought about by including in the composition an agent which delays absorption, for example, aluminum monostearate and gelatin.

Oral compositions generally include an inert diluent or an edible pharmaceutically acceptable carrier. They can be enclosed in gelatin capsules or compressed into tablets. For the purpose of oral therapeutic administration, the active age can be incorporated with excipients and used in the form of tablets, troches, or capsules. Oral compositions can also be prepared using a fluid carrier for use as a mouthwash, wherein the agents in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or agents of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the agents are delivered in the form of an aerosol spray from pressured container or dispenser, which contains a suitable propellant, e.g., a gas such as carbon dioxide, or a nebulizer.

Pharmaceutical compositions can be prepared with pharmaceutically acceptable carriers that will protect the modified oligonucleotides against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art, and the materials can be obtained commercially. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of the modified oligonucleotide calculated to produce the desired therapeutic effect in association with the required pharmaceutical carrier. The specification for the dosage unit forms of the disclosure are dictated by and directly dependent on the unique characteristics of the active agent and the particular therapeutic effect to be achieved.

The pharmaceutical compositions can be included in a container, pack, or dispenser together with instructions for administration.

Examples of pharmaceutically acceptable salts include, but are not limited to, mineral or organic acid salts of basic residues such as amines, alkali or organic salts of acidic residues such as carboxylic acids, and the like. The pharmaceutically acceptable salts include the conventional non-toxic salts or the quaternary ammonium salts of the parent compound formed, for example, from non-toxic inorganic or organic acids.

Techniques for formulation and administration of the disclosed compositions of the invention can be found in Remington: the Science and Practice of Pharmacy, 19th edition, Mack Publishing Co., Easton, PA (1995).

All percentages and ratios used herein, unless otherwise indicated, are by weight. Other features and advantages of the present invention are apparent from the different examples. The provided examples illustrate different components and methodology useful in practicing the present invention. The examples do not limit the claimed invention.

Based on the present disclosure the skilled artisan can identify and employ other components and methodology useful for practicing the present invention. Modified oligonucleotides of the disclosure can be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Modified oligonucleotides can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Modified oligonucleotides of the disclosure can be encapsulated within, or incorporated on the surface of particles. In certain embodiments, the particle is a nanoparticle. Exemplary nanoparticles include liposomes, micelles, polymer-based nanoparticles, lipid-polymer based nanoparticles, and polymeric micelles.

In certain embodiments, the nanoparticle comprises a liposome. Liposomes are spherical vesicles having at least one lipid bilayer, and in some embodiments, an aqueous core. In some embodiments, the lipid bilayer of the liposome may comprise phospholipids. An exemplary but non-limiting example of a phospholipid is phosphatidylcholine, but the lipid bilayer may comprise additional lipids, such as phosphatidylethanolamine. Liposomes may be multilamellar, i.e. consisting of several lamellar phase lipid bilayers, or unilamellar liposomes with a single lipid bilayer. Liposomes can be made in a particular size range that makes them viable targets for phagocytosis. Liposomes can range in size from 20 nm to 100 nm, 100 nm to 400 nm, 1 M and larger, or 200 nm to 3 μM. Examples of lipidoids and lipid-based formulations are provided in U.S. Published application No. 20090023673. In other embodiments, the one or more lipids are one or more cationic lipids. One skilled in the art will recognize which liposomes are appropriate for encapsulation of the modified oligonucleotides described herein.

In certain embodiments, the nanoparticle comprises a micelle. A micelle is an aggregate of surfactant molecules. An exemplary micelle comprises an aggregate of amphiphilic macromolecules, polymers or copolymers in aqueous solution, wherein the hydrophilic head portions contact the surrounding solvent, while the hydrophobic tail regions are sequestered in the center of the micelle.

In certain embodiments, the nanoparticle comprises a polymer based nanoparticle. Polymer based nanoparticles comprise one or more polymers, such as a polyester, poly (orthoester), poly (ethylene imine), poly (caprolactone), polyanhydride, poly (acrylic acid), polyglycolide or poly (urethane). In still other embodiments, the one or more polymers comprise poly (lactic acid) (PLA) or poly (lactic-co-glycolic acid) (PLGA). In exemplary embodiments, the one or more polymers comprise polyalkylene glycol such as polyethylene glycol (PEG), or polyalkylene oxide, such as polyethylene oxide (PEO).

In some embodiments, the nanoparticles or some portion thereof are degradable. In other embodiments, the lipids and/or polymers of the nanoparticles are degradable.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level, activity or expression of HBV nucleic acids can be tested in vitro in a variety of cell types. Cell types used for such analyses are available from commercial vendors (e.g. American Type Culture Collection, Manassas, VA; Zen-Bio, Inc., Research Triangle Park, NC; Clonetics Corporation, Walkersville, MD) and are cultured according to the vendor's instructions using commercially available reagents (e.g. Invitrogen Life Technologies, Carlsbad, CA). Illustrative cell types include, but are not limited to, HuVEC cells, b.END cells, HepG2 cells, Hep3B cells, and primary hepatocytes.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Invitrogen, Carlsbad, CA). Antisense oligonucleotides may be mixed with LIPOFECTIN in OPTI-MEM 1 (Invitrogen, Carlsbad, CA) to achieve the desired final concentration of antisense oligonucleotide and a LIPOFECTIN concentration that may range from 2 to 12 μg/mL per 100 nM antisense oligonucleotide.

Another reagent used to introduce antisense oligonucleotides into cultured cells includes LIPOFECTAMINE (Invitrogen, Carlsbad, CA). Antisense oligonucleotide is mixed with LIPOFECTAMINE in OPTI-MEM 1 reduced serum medium (Invitrogen, Carlsbad, CA) to achieve the desired concentration of antisense oligonucleotide and a LIPOFECTAMINE concentration that may range from 2 to 12 μg/mL per 100 nM antisense oligonucleotide.

Another technique used to introduce antisense oligonucleotides into cultured cells includes electroporation.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

RNA Isolation

RNA analysis can be performed on total cellular RNA or poly (A)+ mRNA. Methods of RNA isolation are well known in the art. RNA is prepared using methods well known in the art, for example, using the TRIZOL Reagent (Invitrogen, Carlsbad, CA) according to the manufacturer's recommended protocols.

Analysis of Inhibition of Target Levels or Expression

Inhibition of levels or expression of a HBV nucleic acid can be assayed in a variety of ways known in the art. For example, target nucleic acid levels can be quantitated by, e.g., Northern blot analysis, competitive polymerase chain reaction (PCR), or quantitative real-time PCR. RNA analysis can be performed on total cellular RNA or poly (A)+ mRNA. Methods of RNA isolation are well known in the art. Northern blot analysis is also routine in the art. Quantitative real-time PCR can be conveniently accomplished using the commercially available ABI PRISM 7600, 7700, or 7900 Sequence Detection System, available from PE-Applied Biosystems, Foster City, CA and used according to manufacturer's instructions.

Quantitative Real-Time PCR Analysis of Target RNA Levels

Quantitation of target RNA levels may be accomplished by quantitative real-time PCR using the ABI PRISM 7600, 7700, or 7900 Sequence Detection System (PE-Applied Biosystems, Foster City, CA) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents may be obtained from Invitrogen (Carlsbad, CA). RT real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN (Invitrogen, Inc. Carlsbad, CA). Cyclophilin A expression is quantified by real time PCR, by being run simultaneously with the target, multiplexing, or separately. Total RNA is quantified using RIBOGREEN RNA quantification reagent (Invitrogen, Inc. Eugene, OR). Methods of RNA quantification by RIBOGREEN are taught in Jones, L. J., et al, (Analytical Biochemistry, 1998, 265, 368-374). A CYTOFLUOR 4000 instrument (PE Applied Biosystems) is used to measure RIBOGREEN fluorescence.

Probes and primers are designed to hybridize to a HBV nucleic acid. Methods for designing real-time PCR probes and primers are well known in the art, and may include the use of software such as PRIMER EXPRESS Software (Applied Biosystems, Foster City, CA).

Quantitative Real-Time PCR Analysis of Target DNA Levels

Quantitation of target DNA levels may be accomplished by quantitative real-time PCR using the ABI PRISM 7600, 7700, or 7900 Sequence Detection System (PE-Applied Biosystems, Foster City, CA) according to manufacturer's instructions. Methods of quantitative real-time PCR are well known in the art.

Gene (or DNA) target quantities obtained by real time PCR are normalized using either the expression level of a gene whose expression is constant, such as cyclophilin A, or by quantifying total DNA using RIBOGREEN (Invitrogen, Inc. Carlsbad, CA). Cyclophilin A expression is quantified by real time PCR, by being run simultaneously with the target, multiplexing, or separately. Total DNA is quantified using RIBOGREEN RNA quantification reagent (Invetrogen, Inc. Eugene, OR). Methods of DNA quantification by RIBOGREEN are taught in Jones, L. J., et al, (Analytical Biochemistry, 1998, 265, 368-374). A CYTOFLUOR 4000 instrument (PE Applied Biosystems) is used to measure RIBOGREEN fluorescence.

Probes and primers are designed to hybridize to a HBV nucleic acid. Methods for designing real-time PCR probes and primers are well known in the art, and may include the use of software such as PRIMER EXPRESS Software (Applied Biosystems, Foster City, CA).

Analysis of Protein Levels

Antisense inhibition of HBV nucleic acids can be assessed by measuring HBV protein levels. Protein levels of HBV can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, MI), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit expression of HBV and produce phenotypic changes. Testing may be performed in normal animals, or in experimental disease models. For administration to animals, antisense oligonucleotides are formulated in a pharmaceutically acceptable diluent, such as phosphate-buffered saline. Administration includes parenteral routes of administration, such as intraperitoneal, intravenous, subcutaneous, intrathecal, and intracerebroventricular. Administration also includes intra-ocular and intramuscular routes of administration. Calculation of antisense oligonucleotide dosage and dosing frequency is within the abilities of those skilled in the art, and depends upon factors such as route of administration and animal body weight. Following a period of treatment with antisense oligonucleotides, RNA is isolated from liver tissue and changes in HBV nucleic acid expression are measured. Changes in HBV DNA levels are also measured. Changes in HBV protein levels are also measured. Changes in HBV HBeAg levels are also measured. Changes in HBV HBsAg levels are also measured.

Certain Indications

In certain embodiments, provided herein are methods, compounds, and compositions of treating an individual comprising administering one or more pharmaceutical compositions provided herein. In certain embodiments, the individual has an HBV-related condition. In certain embodiments, chronic HBV infection, Hepatitis Delta virus (HDV) infection (e.g. in subject co-infected with HBV), inflammation, fibrosis, cirrhosis, liver cancer, serum hepatitis, jaundice, liver cancer, liver inflammation, liver fibrosis, liver cirrhosis, liver failure, diffuse hepatocellular inflammatory disease, hemophagocytic syndrome, serum hepatitis, and HBV viremia. In certain embodiments, the HBV-related condition may have which may include any or all of the following: flu-like illness, weakness, aches, headache, fever, loss of appetite, diarrhea, jaundice, nausea and vomiting, pain over the liver area of the body, clay- or grey-colored stool, itching all over, and dark-colored urine, when coupled with a positive test for presence of a hepatitis B virus, a hepatitis B viral antigen, or a positive test for the presence of an antibody specific for a hepatitis B viral antigen. In certain embodiments, the individual is at risk for an HBV-related condition. This includes individuals having one or more risk factors for developing an HBV-related condition, including sexual exposure to an individual infected with Hepatitis B virus, living in the same house as an individual with a lifelong hepatitis B virus infection, exposure to human blood infected with the hepatitis B virus, injection of illicit drugs, being a person who has hemophilia, and visiting an area where hepatitis B is common. In certain embodiments, the individual has been identified as in need of treatment for an HBV-related condition. In certain embodiments provided herein are methods for prophylactically reducing HBV expression in an individual. Certain embodiments include treating an individual in need thereof by administering to an individual a therapeutically effective amount of an antisense compound targeted to an HBV nucleic acid.

Due to overlapping transmission routes, many people have been exposed to both hepatitis B virus (HBV) and hepatitis C virus (HCV), and a smaller proportion are chronically infected with both viruses, especially in regions such as Asia where HBV is endemic. Estimates suggest that up to 10% of people with HCV may also have HBV, while perhaps 20% of people with HBV are co-infected with HCV. However, treatment of hepatitis B or hepatitis B in I—IBV—HCV co-infected individuals has not been well studied. Treatment is complicated by the fact that HCV and HBV appear to inhibit each other's replication (though not all studied have observed this interaction). Therefore, treatment that fully suppresses HBV could potentially allow HCV to re-emerge, or vice versa. Therefore, the compounds and compositions described herein may advantageously be used for treating patients infected with both HBV and HCV. Exemplary treatment options for hepatitis C (HCV) include interferons, e.g., interferon alpha-2b, interferon alpha-2a, and interferon alphacon-1. Less frequent interferon dosing can be achieved using pegylated interferon (interferon attached to a polyethylene glycol moiety which improves its pharmacokinetic profile). Combination therapy with interferon alpha-2b (pegylated and unpegylated) and ribavirin has also been shown to be efficacious for some patient populations. Other agents currently being developed include HCV RNA replication inhibitors (e.g., ViroPharma's VP50406 series), HCV antisense agents, HCV therapeutic vaccines, HCV protease inhibitors, HCV helicase inhibitors and HCV antibody therapy (monoclonal or polyclonal).

In certain embodiments, treatment with the methods, compounds, and compositions described herein is useful for preventing an HBV-related condition associated with the presence of the hepatitis B virus. In certain embodiments, treatment with the methods, compounds, and compositions described herein is useful for preventing an HBV-related condition.

In one embodiment, administration of a therapeutically effective amount of an antisense compound targeted to an HBV nucleic acid is accompanied by monitoring of HBV mRNA levels in the serum of an individual to determine an individual's response to administration of the antisense compound. In certain embodiments, administration of a therapeutically effective amount of an antisense compound targeted to an HBV nucleic acid is accompanied by monitoring of HBV DNA levels in the serum of an individual to determine an individual's response to administration of the antisense compound. In certain embodiments, administration of a therapeutically effective amount of an antisense compound targeted to an HBV nucleic acid is accompanied by monitoring of HBV protein levels in the serum of an individual to determine an individual's response to administration of the antisense compound. In certain embodiments, administration of a therapeutically effective amount of an antisense compound targeted to an HBV nucleic acid is accompanied by monitoring of HBV S antigen (HBsAg) levels in the serum of an individual to determine an individual's response to administration of the antisense compound. In certain embodiments, administration of a therapeutically effective amount of an antisense compound targeted to an HBV nucleic acid is accompanied by monitoring of HBV E antigen (HBeAg) levels in the serum of an individual to determine an individual's response to administration of the antisense compound. An individual's response to administration of the antisense compound is used by a physician to determine the amount and duration of therapeutic intervention.

In certain embodiments, administration of an antisense compound targeted to an HBV nucleic acid results in reduction of HBV expression by at least 15, 20, 25, 30, 35, 40, 45, 50, 55, 60, 65, 70, 75, 80, 85, 90, 95 or 99%, or a range defined by any two of these values. In certain embodiments, administration of an antisense compound targeted to an HBV nucleic acid results in reduced symptoms associated with the HBV-related condition and reduced HBV-related markers in the blood. In certain embodiments, administration of an HBV antisense compound decreases HBV RNA levels, HBV DNA levels, HBV protein levels, HBsAg levels, or HBeAg levels by at least 15, 20, 25, 30, 35, 40, 45, 50, 55, 60, 65, 70, 75, 80, 85, 90, 95 or 99%, or a range defined by any two of these values.

In certain embodiments, pharmaceutical compositions comprising an antisense compound targeted to HBV are used for the preparation of a medicament for treating a patient suffering or susceptible to an HBV-related condition.

Certain Combination Therapies

In certain embodiments, one or more pharmaceutical compositions provided herein are co-administered with one or more other pharmaceutical agents. In certain embodiments, such one or more other pharmaceutical agents are designed to treat the same disease, disorder, or condition as the one or more pharmaceutical compositions provided herein. In certain embodiments, such one or more other pharmaceutical agents are designed to treat a different disease, disorder, or condition as the one or more pharmaceutical compositions provided herein.

In certain embodiments, such one or more other pharmaceutical agents are designed to treat an undesired side effect of one or more pharmaceutical compositions provided herein. In certain embodiments, one or more pharmaceutical compositions provided herein are co-administered with another pharmaceutical agent to treat an undesired effect of that other pharmaceutical agent. In certain embodiments, one or more pharmaceutical compositions provided herein are co-administered with another pharmaceutical agent to produce a combinational effect. In certain embodiments, one or more pharmaceutical compositions provided herein are co-administered with another pharmaceutical agent to produce a synergistic effect.

In certain embodiments, one or more pharmaceutical compositions provided herein and one or more other pharmaceutical agents are administered at the same time. In certain embodiments, one or more pharmaceutical compositions provided herein and one or more other pharmaceutical agents are administered at different times. In certain embodiments, one or more pharmaceutical compositions provided herein and one or more other pharmaceutical agents are prepared together in a single formulation. In certain embodiments, one or more pharmaceutical compositions provided herein and one or more other pharmaceutical agents are prepared separately.

ENUMERATED EMBODIMENTS

While various specific embodiments have been illustrated and described, it will be appreciated that various changes can be made without departing from the spirit and scope of the disclosure(s). The present disclosure is exemplified by the numbered embodiments set forth below.

Set I:

Embodiment I-1. A compound comprising a modified oligonucleotide of 20 linked nucleosides consisting of:

a first gap segment consisting of linked nucleosides;

a second gap segment consisting of linked nucleosides;

a separator segment consisting of a nucleoside linked to the first gap segment and the second gap segment;

a 5' wing segment consisting of linked nucleosides; and a 3' wing segment consisting of linked nucleosides;

wherein the first gap segment, separator segment, and second gap segment are positioned between the 5' wing segment and the 3' wing segment;

wherein the first gap segment is attached to the 5' wing segment, and the second gap segment is attached to the 3' wing segment wherein the first gap segment, separator segment, and second gap segment, taken together, consist of from 8 to 12 linked nucleosides.

Embodiment I-2. The compound of embodiment I-1, wherein the first gap segment consists of linked nucleosides with 2'-deoxy sugars.

Embodiment I-3. The compound of embodiment I-1 or I-2, wherein the second gap segment consists of linked nucleosides with 2'-deoxy sugars.

Embodiment I-4. The compound of a preceding embodiment, wherein the separator segment consists of one nucleoside comprising a 2'-O(CH$_2$)$_2$—OCH$_3$ sugar or a 2'—OCH$_3$ sugar.

Embodiment I-5. The compound of a preceding embodiment, wherein at least one of the nucleosides in the 5' wing segment comprises a 2'-O(CH$_2$)$_2$—OCH$_3$ sugar.

Embodiment I-6. The compound of a preceding embodiment, wherein at least one of the nucleosides in the 3' wing segment comprises a 2'-O(CH$_2$)$_2$—OCH$_3$ sugar.

Embodiment I-7. The compound of a preceding embodiment, wherein the modified oligonucleotide is at least 75%, or at least 80%, or at least 85%, or at least 90%, or at least 95%, or 100% complementary to a HBV nucleic acid.

Embodiment I-8. The compound of a preceding embodiment, wherein the modified oligonucleotide has a nucleobase sequence of SEQ ID NO: 2 (GCAGA GGTGA AGCGA AGTGC).

Embodiment I-9. The compound of a preceding embodiment, wherein the modified oligonucleotide is a single-stranded modified oligonucleotide.

Embodiment I-10. The compound of a preceding embodiment, wherein at least one internucleoside linkage is a modified internucleoside linkage.

Embodiment I-11. The compound of embodiment I-10, wherein each internucleoside linkage is a phosphorothioate internucleoside linkage.

Embodiment I-12. The compound of a preceding embodiment, wherein the modified oligonucleotide comprises at least one modified nucleobase.

Embodiment I-13. The compound of a preceding embodiment, wherein the modified oligonucleotide comprises one, two, or three modified nucleobase(s).

Embodiment I-14. The compound of embodiment I-12 or I-13, wherein the modified nucleobase is a 5-methylcytosine.

Embodiment I-15. The compound of embodiment I-1, wherein the cytosines at positions 2, 13, and 20 of SEQ ID NO: 2 are each 5-methylcytosine.

Embodiment I-16. The compound a preceding embodiment, wherein each of the nucleosides in the 5' wing segment comprise a 2'-O(CH$_2$)$_2$—OCH$_3$ sugar.

Embodiment I-17. The compound of a preceding embodiment, wherein each of the nucleosides in the 3' wing segment comprise a 2'-O(CH$_2$)$_2$—OCH$_3$ sugar.

Embodiment I-18. The compound of embodiments 1 to I-15, wherein the 5' wing segment comprises a nucleoside with a 2'-deoxy sugar.

Embodiment I-19. The compound of embodiment I-18, wherein the other nucleosides in the 5' wing segment comprise a 2'-O(CH$_2$)$_2$—OCH$_3$ sugar.

Embodiment I-20. The compound of embodiment I-1, wherein the nucleoside at position 2 of SEQ ID NO: 2 comprises a 2'-deoxy sugar.

Embodiment I-21. The compound of embodiment I-1, wherein the 5' wing segment further comprises two nucleosides each with a 2'-deoxy sugar.

Embodiment I-22. The compound of embodiment I-1, wherein the nucleosides at positions 2 and 5 of SEQ ID NO: 2 comprise a 2'-deoxy sugar.

Embodiment I-23. The compound of embodiment I-1, wherein the 3' wing segment comprises a nucleoside with a 2'-deoxy sugar.

Embodiment I-24. The compound of embodiment I-23, wherein the other nucleosides in the 3' wing segment comprise a 2'-O(CH$_2$)$_2$—OCH$_3$ sugar.

Embodiment I-25. The compound of embodiment I-1, wherein the nucleoside at position 16 of SEQ ID NO: 2 comprises a 2'-deoxy sugar.

Embodiment I-26. The compound of embodiment I-1, wherein one, two, three, or four of the nucleosides in the 5' wing segment comprise a 4'-CH$_2$—O-2' sugar.

Embodiment I-27. The compound of embodiment I-26, wherein two of the nucleosides in the 5' wing segment comprise a 4'-CH$_2$—O-2' sugar.

Embodiment I-28. The compound of embodiment I-1, wherein the nucleosides at positions 1 and 3 of SEQ ID NO: 2 comprise a 4'-CH$_2$—O-2' sugar.

Embodiment I-29. The compound of embodiment I-1, wherein one, two, three, or four of the nucleosides in the 3' wing segment comprise a 4'-CH$_2$—O-2' sugar.

Embodiment I-30. The compound of embodiment I-29, wherein two of the nucleosides in the 3' wing segment comprise a 4'-CH$_2$—O-2' sugar.

Embodiment I-31. The compound of embodiment I-1, wherein the nucleosides at positions 17 and 18 of SEQ ID NO: 2 comprise a 4'-CH$_2$—O-2' sugar.

Embodiment I-32. The compound of embodiment I-1, wherein the nucleosides at positions 16 and 19 of SEQ ID NO: 2 comprise a 4'-CH$_2$—O-2' sugar.

Embodiment I-33. The compound of embodiment I-1, wherein the nucleosides at positions 17 and 20 of SEQ ID NO: 2 comprise a 4'-CH$_2$—O-2' sugar.

Embodiment I-34. The compound of embodiment I-29, wherein three of the nucleosides in the 3' wing segment comprise a 4'-CH$_2$—O-2' sugar.

Embodiment I-35. The compound of embodiment I-1, wherein the nucleosides at positions 17, 19, and 20 of SEQ ID NO: 2 comprise a 4'-CH$_2$—O-2' sugar.

Embodiment I-36. The compound of a preceding embodiment, wherein the first gap segment consists of 1, 2, 3, 4, 5, 6, 7, or 8 linked nucleosides.

Embodiment I-37. The compound of a preceding embodiment, wherein the first gap segment consists of 4 or 5 linked nucleosides.

Embodiment I-38. The compound of a preceding embodiment, wherein the first gap segment consists of 4 linked nucleosides.

Embodiment I-39. The compound of a preceding embodiment, wherein the second gap segment consists of 1, 2, 3, 4, 5, 6, 7, or 8 linked nucleosides.

Embodiment I-40. The compound of a preceding embodiment, wherein the second gap segment consists of 5 or 6 linked nucleosides.

Embodiment I-41. The compound of a preceding embodiment, wherein the second gap segment consists of 5 linked nucleosides.

Embodiment I-42. The compound of a preceding embodiment, wherein the separator segment is at position 7 or 8 or 9 or 10 or 11 or 12 or 13 or 14 of SEQ ID NO: 2.

Embodiment I-43. The compound of a preceding embodiment, wherein the separator segment is at position 9 or 10 or 11 of SEQ ID NO: 2.

Embodiment I-44. The compound of a preceding embodiment, wherein the separator segment is at position 10 of SEQ ID NO: 2.

Embodiment I-45. The compound of embodiment I-1, wherein the 5' wing segment consists of 5 linked nucleosides; and
the 3' wing segment consists of 5 linked nucleosides;
the first gap segment consists of 4 linked nucleosides with 2'-deoxy sugars;
the second gap segment consists of 5 linked nucleosides with 2'-deoxy sugars;
the separator segment is at position 10 of SEQ ID NO:2;
the cytosines at positions 2, 13, and 20 of SEQ ID NO: 2 are each 5-methylcytosine each internucleoside linkage is a phosphorothioate internucleoside linkage.

Embodiment I-46. The compound of embodiment I-1, wherein the 5' wing segment consists of 4 linked nucleosides; and
the 3' wing segment consists of 5 linked nucleosides;
the first gap segment consists of 5 linked nucleosides with 2'-deoxy sugars;
the second gap segment consists of 5 linked nucleosides with 2'-deoxy sugars;
the separator segment is at position 10 of SEQ ID NO:2;
the cytosines at positions 2, 13, and 20 of SEQ ID NO: 2 are each 5-methylcytosine;
each internucleoside linkage is a phosphorothioate internucleoside linkage.

Embodiment I-47. The compound of embodiment I-1, wherein the 5' wing segment consists of 5 linked nucleosides; and
the 3' wing segment consists of 4 linked nucleosides;
the first gap segment consists of 4 linked nucleosides with 2'-deoxy sugars;
the second gap segment consists of 6 linked nucleosides with 2'-deoxy sugars; and
the separator segment is at position 10 of SEQ ID NO:2;
each internucleoside linkage is a phosphorothioate internucleoside linkage.

Embodiment I-48. The compound of embodiment I-1, wherein the 5' wing segment consists of 4 linked nucleosides; and
the 3' wing segment consists of 6 linked nucleosides;
the first gap segment consists of 5 linked nucleosides with 2'-deoxy sugars;
the second gap segment consists of 4 linked nucleosides with 2'-deoxy sugars; and
the separator segment is at position 10 of SEQ ID NO:2;
each internucleoside linkage is a phosphorothioate internucleoside linkage.

Embodiment I-49. The compound of embodiment I-1, wherein the 5' wing segment consists of 5 linked nucleosides; and the 3' wing segment consists of 6 linked nucleosides;

the first gap segment consists of 4 linked nucleosides with 2'-deoxy sugars;
the second gap segment consists of 4 linked nucleosides with 2'-deoxy sugars;
each internucleoside linkage is a phosphorothioate internucleoside linkage.

Embodiment I-50. The compound of embodiment I-1, wherein the modified oligonucleotide has a sequence which is a member selected from the group consisting of A, B, C, D, E, F, G, H, I, J, K, L, M, N, O, P, Q, R, S, T, U, V, W, X, Y, Z, AA, AB, AC, AD, AE, AF, AG, AH, AI, AJ, AK, AL, AM, AN, AO, AP, AQ, AR, AS, AT, AU, AV, AW, and AX.

Embodiment I-51. A composition comprising the compound of any of embodiments I-1 to I-50 or salt thereof and at least one of a pharmaceutically acceptable carrier or diluent.

Embodiment I-52. A method comprising administering to an animal the compound or composition of any of embodiments I-1 to I-51.

Embodiment I-53. The method of embodiment I-52, wherein the animal is a human.

Embodiment I-54. The method of embodiment I-52, wherein administering the compound prevents, treats, ameliorates, or slows progression of a HBV-related disease, disorder or condition.

Embodiment I-55. The method of embodiment I-54, wherein the disease, disorder or condition is liver disease.

Embodiment I-56. The method of embodiment I-54, wherein the disease, disorder or condition is jaundice, liver inflammation, liver fibrosis, inflammation, liver cirrhosis, liver failure, diffuse hepatocellular inflammatory disease, hemophagocytic syndrome, serum hepatitis, HBV viremia, or liver disease-related transplantation.

Embodiment I-57. The method of embodiment I-54, wherein the disease or condition is a hyperproliferative condition.

Embodiment I-58. The method of embodiment I-57, wherein the hyperproliferative condition is liver cancer.

Embodiment I-59. A method of reducing HBV antigen levels in an animal comprising administering to said animal the compound or composition of any of embodiments I-1 to I-51.

Embodiment I-60. The method of embodiment I-59, wherein HBsAg levels are reduced.

Embodiment I-61. The method of embodiment I-59, wherein HBeAg levels are reduced.

Embodiment I-62. The method of embodiment I-59, wherein the animal is human.

Set II

Embodiment II-1. A compound comprising a modified oligonucleotide, the modified oligonucleotide comprising from 5' to 3':

$$\text{5'W1-G1-S1-G2-W2 3'} \qquad \text{(Formula I)}$$

wherein:
W1 is a 5' wing segment;
W2 is a 3' wing segment;
G1 is a first gap segment;
S1 is a first separator segment;
G2 is a second gap segment;
- is an internucleoside linkage; and
at least one nucleoside of the oligonucleotide is modified.

Embodiment II-2. The compound of embodiment II-1, wherein the modified oligonucleotide comprises from 5' to 3':

$$\text{5'W1-G1-S1-G2-S2-G3-W2 3'} \qquad \text{(Formula II)}$$

wherein:
S2 is a second separator segment; and
G3 is a third gap segment.

Embodiment II-3. The compound of embodiment II-2, wherein the modified oligonucleotide comprises from 5' to 3':

$$\text{5'W1-G1-S1-G2-S2-G3-S3-G4-W2 3'} \qquad \text{(Formula III)}$$

wherein:
S3 is a third separator segment; and
G4 is a fourth gap segment.

Embodiment II-4. The compound of embodiment II-3, wherein the modified oligonucleotide comprises from 5' to 3':

$$\text{5'W1-G1-S1-G2-S2-G3-S3-G4-S4-G5-W2 3'} \qquad \text{(Formula IV)}$$

wherein:
S4 is a fourth separator segment; and
G5 is a fifth gap segment.

Embodiment II-5. The compound of embodiment II-4, wherein the modified oligonucleotide comprises from 5' to 3':

$$\text{5'W1-G1-S1-G2-S2-G3-S3-G4-S4-G5-S5-G6-W2 3'} \qquad \text{(Formula V)}$$

wherein:
S5 is a fifth separator segment; and
G6 is a sixth gap segment.

Embodiment II-6. The compound of embodiment II-5, wherein the modified oligonucleotide comprises from 5' to 3':

$$\text{5'W1-G1-S1-G2-S2-G3-S3-G4-S4-G5-S5-G6-S6-G7-W2 3'} \qquad \text{(Formula VI)}$$

wherein:
S6 is a sixth separator segment; and
G7 is a seventh gap segment.

Embodiment II-7. The compound of any one of embodiments II-1 to II-6, wherein W1 comprises one or more linked deoxynucleosides.

Embodiment II-8. The compound of any one of embodiments II-1 to II-7, wherein W2 comprises one or more linked deoxynucleosides.

Embodiment II-9. The compound of any one of embodiments II-1 to II-8, wherein W1 comprises 2 to 25 linked nucleosides.

Embodiment II-10. The compound of any one of embodiments II-1 to II-9, wherein W2 comprises 2 to 35 linked nucleosides.

Embodiment II-11. The compound of any one of embodiments II-1 to II-10, wherein G1 comprises 1 to 10 linked deoxynucleosides.

Embodiment II-12. The compound of any one of embodiments II-1 to II-11, wherein G2 comprises 1 to 10 linked deoxynucleosides.

Embodiment II-13. The compound of any one of embodiments II-1 to II-12, wherein S1 comprises 1 to 3 linked nucleosides.

Embodiment II-14. The compound of any one of embodiments II-2 to II-13, wherein G3 comprises 1 to 10 linked deoxynucleosides.

Embodiment II-15. The compound of any one of embodiments II-2 to II-14, wherein S2 comprises 1 to 3 linked nucleosides.

Embodiment II-16. The compound of any one of embodiments II-3 to II-15, wherein G4 comprises 1 to 10 linked deoxynucleosides.

Embodiment II-17. The compound of any one of embodiments II-3 to II-16, wherein S3 comprises 1 or 2 linked nucleosides.

Embodiment II-18. The compound of any one of embodiments II-4 to II-17, wherein G5 comprises 1 to 10 linked deoxynucleosides.

Embodiment II-19. The compound of any one of embodiments II-4 to II-17, wherein S4 comprises 1 to 3 linked nucleosides.

Embodiment II-20. The compound of any one of embodiments II-5 to II-19, wherein G6 comprises 1 to 10 linked deoxynucleosides.

Embodiment II-21. The compound of any one of embodiments II-5 to II-19, wherein S5 comprises 1 to 3 linked nucleosides.

Embodiment II-22. The compound of any one of embodiments II-6 to II-21, wherein G7 comprises 1 to 10 linked deoxynucleosides.

Embodiment II-23. The compound of any one of embodiments II-6 to II-22, wherein S6 comprises 1 to 3 linked nucleosides.

Embodiment II-24. The compound of any one of embodiments II-1 to II-23, wherein the oligonucleotide is 18-50 nucleobases in length.

Embodiment II-25. The compound of any one of embodiments II-1 to II-23, wherein the oligonucleotide is at least 20 nucleobases in length.

Embodiment II-26. The compound of any one of embodiments II-1 to II-23, wherein the oligonucleotide is 20 nucleobases in length.

Embodiment II-27. The compound of embodiment II-1, wherein the oligonucleotide is 20 linked nucleobases in length.

Embodiment II-28. The compound of embodiment II-27, wherein W1 comprises 4 linked nucleosides.

Embodiment II-29. The compound of embodiment II-27, wherein W1 comprises 5 linked nucleosides.

Embodiment II-30. The compound of any one of embodiments II-27 to II-29, wherein G1 comprises 4 linked deoxynucleosides.

Embodiment II-31. The compound of any one of embodiments II-27 to II-29, wherein G1 comprises 5 linked deoxynucleosides.

Embodiment II-32. The compound of any one of embodiments II-27 to II-29, wherein G1 comprises 6 linked deoxynucleosides.

Embodiment II-33. The compound of any one of embodiments II-27 to II-32, wherein G2 comprises 4 linked deoxynucleosides.

Embodiment II-34. The compound of any one of embodiments II-27 to II-32, wherein G2 comprises 5 linked deoxynucleosides.

Embodiment II-35. The compound of any one of embodiments II-27 to II-32, wherein G2 comprises 6 linked deoxynucleosides.

Embodiment II-36. The compound of any one of embodiments II-27 to II-33, wherein S1 comprises at least one linked nucleoside.

Embodiment II-37. The compound of any one of embodiments II-27 to II-35, wherein W2 comprises 5 linked nucleosides.

Embodiment II-38. The compound of any one of embodiments II-27 to II-35, wherein W2 comprises 6 linked nucleosides.

Embodiment II-39. The compound of any one of embodiments II-27 to II-38, wherein the S1 is at position 10 of the oligonucleotide.

Embodiment II-40. The compound of embodiment II-39, wherein W1 comprises 4 linked nucleosides, G1 comprises 5 linked deoxynucleosides, S1 comprises 1 linked nucleoside, G2 comprises 5 linked deoxynucleosides, and W2 comprises 5 linked nucleosides.

Embodiment II-41. The compound of embodiment II-1, wherein W1 comprises 4-6 linked nucleosides.

Embodiment II-42. The compound of embodiment II-41, wherein W2 comprises 4-6 linked nucleosides.

Embodiment II-43. The compound of any one of embodiments II-41 to II-42, wherein G1 comprises 1-6 linked deoxynucleosides.

Embodiment II-44. The compound of any one of embodiments II-41 to II-43, wherein G2 comprises 1-6 linked deoxynucleosides.

Embodiment II-45. The compound of any one of embodiments II-41 to II-44, wherein G3 comprises 1-6 linked deoxynucleosides.

Embodiment II-46. The compound of any one of embodiments II-41 to II-45, wherein S1 comprises least one linked nucleoside.

Embodiment II-47. The compound of any one of embodiments II-41 to II-46, wherein the length of the G1-S1-G2 is between 8 and 12 nucleobases in length.

Embodiment II-48. The compound of any one of embodiments II-1 to II-47, wherein any one or more of G1, G2, G3, G4, G5, G6, and G7 comprises a nucleoside comprising a modification to a 2'-deoxynucleoside.

Embodiment II-49. The compound of embodiment II-48, wherein any one or more of G1, G2, G3, G4, G5, G6, and G7 comprises a nucleoside comprising a 2'-deoxy 5-methylcytidine sugar modification.

Embodiment II-50. The compound of any one of embodiments II-1 to II-49, wherein S1, S2, S3, S4, S5, and/or S6 comprises a nucleoside comprising a 2'-O-methoxyethyl sugar modification.

Embodiment II-51. The compound of any one of embodiments II-1 to II-49, wherein S1, S2, S3, S4, S5, and/or S6 comprises a nucleoside comprising a 5-methylcytidine.

Embodiment II-52. The compound of any one of embodiments II-1 to II-49, wherein S1, S2, S3, S4, S5, and/or S6 comprises a nucleoside comprising a 2'-O-methyl sugar modification.

Embodiment II-53. The compound of any one of embodiments II-1 to II-52, wherein S1, S2, S3, S4, S5, and/or S6 comprises a nucleoside comprising a 2'-OH sugar modification.

Embodiment II-54. The compound of any one of embodiments II-1 to II-53, wherein S1, S2, S3, S4, S5, and/or S6 comprises a nucleoside comprising a 2'-fluoro sugar modification.

Embodiment II-55. The compound of any one of embodiments II-1 to II-54, wherein S1, S2, S3, S4, S5, and/or S6 comprises a nucleoside comprising a 2'-fluoro-arabinonucleic acid (2'-fluoro-ANA) sugar modification.

Embodiment II-56. The compound of any one of embodiments II-1 to II-55, wherein S1, S2, S3, S4, S5, and/or S6 comprises a glycol nucleic acid (GNA).

Embodiment II-57. The compound of any one of embodiments II-1 to II-56, wherein S1, S2, S3, S4, S5, and/or S6 comprises a LNA.

Embodiment II-58. The compound of any one of embodiments II-1 to II-57, wherein W1 comprises a nucleoside comprising a 2'-deoxy sugar modification.

Embodiment II-59. The compound of embodiment II-58, wherein the 2'-deoxy sugar modification is at positions 2 and/or 5 of a sequence corresponding to SEQ ID NO: 2.

Embodiment II-60. The compound of any one of embodiments II-1 to II-59, wherein W1 comprises a nucleoside comprising a 2'-O-methoxyethyl sugar modification.

Embodiment II-61. The compound of embodiment II-60, wherein the 2'-O-methoxyethyl sugar modification is at position 1, 2, 3, 4 and/or 5 of a sequence corresponding to SEQ ID NO: 2.

Embodiment II-62. The compound of any one of embodiments II-1 to II-61, wherein W1 comprises a 2'-O-methoxyethyl 5-methylcytidine at position 2 of a sequence corresponding to SEQ ID NO: 2.

Embodiment II-63. The compound of any one of embodiments II-1 to II-62, wherein W1 comprises a nucleoside comprising a 2'-O-methyl sugar modification.

Embodiment II-64. The compound of embodiment II-63, wherein the 2'-O-methyl sugar modification is at positions 1, 2, 3, 4 and/or 5 of a sequence corresponding to SEQ ID NO: 2.

Embodiment II-65. The compound of embodiment II-63, wherein W1 comprises a 2'-O-methyl 5-methylcytidine at position 2 of a sequence corresponding to SEQ ID NO: 2.

Embodiment II-66. The compound of any one of embodiments II-1 to II-65, wherein W1 comprises a nucleoside comprising a 2'-fluoro sugar modification.

Embodiment II-67. The compound of any one of embodiments II-1 to II-66, wherein W1 comprises a nucleoside comprising a 2'-fluoro-arabinonucleic acid (2'-fluoro-ANA) modification.

Embodiment II-68. The compound of any one of embodiments II-1 to II-67, wherein W1 comprises a glycol nucleic acid (GNA).

Embodiment II-69. The compound of any one of embodiments II-1 to II-67, wherein the GNA is at position 2 of a sequence corresponding to SEQ ID NO: 2.

Embodiment II-70. The compound of any one of embodiments II-1 to II-69, wherein W1 comprises a modified nucleoside and wherein the modified nucleoside is a locked nucleic acid (LNA).

Embodiment II-71. The compound of embodiment II-70, wherein the LNA is at positions 1 and/or 3 of a sequence corresponding to SEQ ID NO: 2.

Embodiment II-72. The compound of any one of embodiments II-1 to II-71, wherein W2 comprises a nucleoside comprising a 2'-deoxy sugar modification.

Embodiment II-73. The compound of embodiment II-72, wherein the 2'-deoxy sugar modification is at positions 15 and/or 16 of a sequence corresponding to SEQ ID NO: 2.

Embodiment II-74. The compound of any one of embodiments II-1 to II-73, wherein W2 comprises a nucleoside comprising a 2'-O-methoxyethyl sugar modification.

Embodiment II-75. The compound of embodiment II-74, wherein the 2'-O-methoxyethyl sugar modification is at positions 15, 16, 17, 18, 19 and/or 20 of a sequence corresponding to SEQ ID NO: 2.

Embodiment II-76. The compound of embodiment II-74, wherein W2 comprises a 2'-O-methoxyethyl 5-methylcytidine at position 20 of a sequence corresponding to SEQ ID NO: 2.

Embodiment II-77. The compound of any one of embodiments II-1 to II-76, wherein W2 comprises a nucleoside comprising a 2'-O-methyl sugar modification.

Embodiment II-78. The compound of embodiment II-77, wherein the 2'-O-methyl sugar modification is at positions 15, 16, 17, 18, 19 and/or 20 of a sequence corresponding to SEQ ID NO: 2.

Embodiment II-79. The compound of embodiment II-77, wherein W2 comprises a 2'-O-methyl 5-methylcytidine at position 20 of a sequence corresponding to SEQ ID NO: 2.

Embodiment II-80. The compound of any one of embodiments II-1 to II-79, wherein W2 comprises a nucleoside comprising a 2'-fluoro sugar modification.

Embodiment II-81. The compound of any one of embodiments II-1 to II-80, wherein W2 comprises a nucleoside comprising a 2'-fluoro-arabinonucleic acid (2'-fluoro-ANA) modification.

Embodiment II-82. The compound of any one of embodiments II-1 to II-81, wherein W2 comprises a modified nucleoside and wherein the modified nucleoside is a glycol nucleic acid (GNA).

Embodiment II-83. The compound of any one of embodiments II-1 to II-82, wherein W2 comprises a modified nucleoside and wherein the modified nucleoside is a locked nucleic acid (LNA).

Embodiment II-84. The compound of embodiment II-83, wherein the LNA is at positions 16, 17, 18, 19 and/or 20 of a sequence corresponding to SEQ ID NO: 2.

Embodiment II-85. The compound of any one of embodiments II-1 to II-84, wherein at least one internucleoside linkage is a phosphodiester linkage.

Embodiment II-86. The compound of any one of embodiments II-1 to II-85, wherein at least one internucleoside linkage is a modified internucleoside linkage.

Embodiment II-87. The compound of embodiment II-86, wherein the modified internucleoside linkage is a phosphorothioate internucleoside linkage.

Embodiment II-88. The compound of any one of embodiments II-1 to II-86, wherein the oligonucleotide is complementary to a portion of the polynucleotide sequence of a HBV genome.

Embodiment II-89. The compound of embodiment II-88, wherein the HBV genome is the genome of HBV GT-A, GT-B, GT-C, GT-D, GT-E, GT-F, GT-G, or GT-H.

Embodiment II-90. The compound of embodiment II-88, wherein the oligonucleotide is at least 60%, 65%, 70%, 75%, 80%, 85%, 90%, 91%, 92%, 93%, 94%, 95%, 96%, 97%, 98%, 99% or 100% complementary to a portion of the polynucleotide sequence of any one of SEQ ID NOS: SEQ ID NO 3, and 667-674.

Embodiment II-91. The compound of embodiment II-88, wherein the oligonucleotide is complementary to the polynucleotide sequence of any one of SEQ ID NOs: 1, 4, and 675-838.

Embodiment II-92. The compound of any one of embodiments II-1 to II-91, wherein the oligonucleotide comprises a nucleobase sequence of a sequence corresponding to SEQ ID NO: 2 or a nucleobase sequence of.

Embodiment II-93. A compound comprising the modified oligonucleotide of any one of SEQ ID NOS: 11-666, or a oligonucleotide comprising at least 1, 2, 3, 4, or 5 further modifications thereto.

Embodiment II-94. A compound comprising the modified oligonucleotide of any one of SEQ ID NOS: 11-666, or a oligonucleotide having at least 70%, at least 80%, at least 90%, at least 95%, or at least 99% sequence identity thereto.

Embodiment II-95. A pharmaceutical composition comprising the compound of any one of embodiments II-1 to II-94, or salt thereof and at least one pharmaceutically acceptable carrier or diluent.

Embodiment II-96. A formulation comprising about 100 mg/mL, 150 mg/mL, or 200 mg/mL of a compound comprising the modified oligonucleotide sequence of SEQ ID NO: 456, or a oligonucleotide comprising at least 1, 2, 3, 4, or 5 further modifications thereto.

Embodiment II-97. A method of reducing HBV antigen levels in a subject comprising administering to the subject the compound of any one of embodiments II-1 to II-94, the composition of embodiment II-95 or the formulation of embodiment II-96.

Embodiment II-98. The method of embodiment II-97, wherein the HBV antigen is HBsAg or HBeAg.

Embodiment II-99. The method of embodiment II-97, wherein HBeAg levels are reduced.

Embodiment II-100. The method of embodiment II-97, wherein HBsAg levels are reduced.

Embodiment II-101. The method of embodiment II-97, wherein, wherein the HBsAg levels are reduced by at least about 1.25 fold relative to a subject administered with a composition comprising the modified oligonucleotide sequence of SEQ ID NO: 10.

Embodiment II-102. The method of embodiment II-97, wherein the HBsAg levels are reduced by about 2 fold to about 10 fold relative to a subject administered with a composition comprising the modified oligonucleotide sequence of SEQ ID NO: 10.

Embodiment II-103. A method of reducing liver toxicity and/or persistence in a subject having HBV comprising administering to a subject the compound of any one of embodiments II-1 to 94, the composition of embodiment II-95 or the formulation of embodiment II-96.

Embodiment II-104. The method of embodiment II-103, wherein ALT, ALP, and/or AST levels are reduced, optionally by at least about 1.25 fold relative to a subject administered with a composition comprising the modified oligonucleotide sequence of SEQ ID NO: 10.

Embodiment II-105. A method of preventing, treating, ameliorating or slowing the progression of a HBV-related disease, disorder or condition comprising administering to a subject the compound of any one of embodiments II-1 to II-94, the composition of embodiment II-95 or the formulation of embodiment II-96.

Embodiment II-106. The method of any one of embodiments II-97 to II-105, wherein the subject is administered with at least one, at least 2, at least 3, at least 4 or at least 5 doses of the compound, the composition or the formulation.

Embodiment II-107. The method of any one of embodiments II-97 to II-106, wherein the subject is dosed on Day 1, Day 4 and Day 8.

Embodiment II-108. The method of embodiment II-107, wherein the subject is dosed once every week after Day 8.

Embodiment II-109. The method of any one of embodiments II-97 to II-108, wherein the subject is dosed on at least Day 1, Day 4 and Day 8, Day 15 and Day 22.

Embodiment II-110. The method of any one of embodiments II-107 to II-109, wherein the amount of each dose is substantially the same amount.

Embodiment II-111. The method of any one of embodiments II-97 to II-110, wherein the dose is about 30 mg to about 600 mg.

Embodiment II-112. The method of any one of embodiments II-97 to II-110, wherein the dose is about 100 mg to about 500 mg.

Embodiment II-113. The method of any one of embodiments II-97 to II-110, wherein the dose is about 100 mg, about 150 mg, about 200 mg, about 250 mg, about 300 mg, about 450 mg, or about 500 mg.

Embodiment II-114. The method of any one of embodiments II-97 to II-113, wherein the administering to a subject is parenteral.

Embodiment II-115. The method of any one of embodiments II-97 to II-113, wherein the administering to a subject is subcutaneous.

Embodiment II-116. The method of any one of embodiments II-97 to II-113, wherein the administering to a subject is transdermal.

Embodiment II-117. The method of any one of embodiments II-97 to II-113, wherein the administering to a subject is intraocular.

Embodiment II-118. The method of any one of embodiments II-97 to II-113, wherein the administering to a subject is intramuscular.

Embodiment II-119. The method of any one of embodiments II-97 to II-113, wherein the administering to a subject is intravenous.

Embodiment II-120. The method of any one of embodiments II-97 to II-115, wherein the method further comprises administering at least a second agent to the subject.

Embodiment II-121. The method of any one of embodiments II-97 to II-120, wherein the disease, disorder or condition is a liver disease, disorder or condition.

Embodiment II-122. The method of embodiment II-121, wherein the disease, disorder or condition is jaundice, liver inflammation, liver fibrosis, inflammation, liver cirrhosis, liver failure, diffuse hepatocellular inflammatory disease, hemophagocytic syndrome, serum hepatitis, HBV infection, HBV viremia, or liver disease-related transplantation.

Embodiment II-123. The method of embodiment II-121, wherein the disease or condition is a hyperproliferative condition, optionally liver cancer.

Embodiment II-124. The method of any one of embodiments II-97 to II-120, wherein the disease, disorder or condition is a hepatitis delta virus infection (HDV), wherein the subject is co-infected with HBV.

Embodiment II-125. The method of any one of embodiments II-97 to II-124, wherein the subject is human.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Modified Oligonucleotide Sequences and Methods of Making

Structures of the modified oligonucleotides of the invention (alternatively known as enhanced AntiSense Oligonucleotides [eASO]) are shown in Tables 1.1 and Table 1.2 (FIGS. 1-2). Table 1.1 shows a legend describing the individual modifications at each position of the modified oligonucleotides. Table 1.2 shows the sequence of each modified oligonucleotides, aligned by position number.

Figure 3:
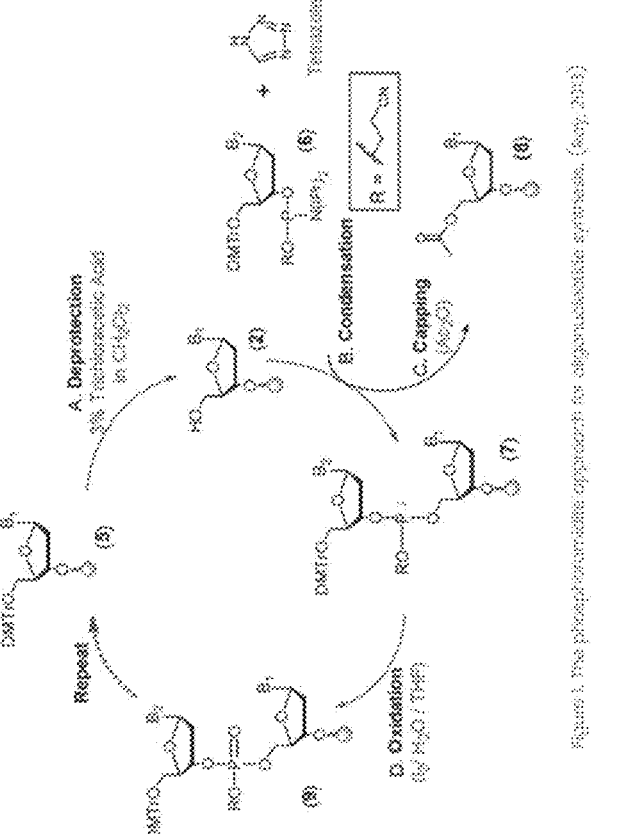
FIG. 3 shows a schematic diagram for the solid-phase synthesis process used to produce the modified oligonucleotides.

Synthesis: Using solid-phase synthesis to produce an oligonucleotide. This means that oligonucleotides will be tethered to a solid surface when they are being made. In other words, within the solid-phase synthesis, an oligonucleotide being assembled is covalently bound, via its 3'-terminal hydroxyl group, to solid support material and remains attached to it over the entire course of the chain assembly. This synthesis process begins with the 3'-most nucleotide and proceeds through a series of cycles composed of four steps that are repeated until the 5'-most nucleotide is attached. These four steps are deprotection (A), condensation (B), capping (C), and oxidation (D) are shown in FIG. 3 and stated below:

Step 1: Remove the DMTr attached to the 5'—OH group of the first base on the CPG monomer, and prepare to attach the next new base;

Step 2: Activate the new base monomer and prepare to react with the first base;

Step 3: The second base has a coupling reaction with the first base;

Step 4: Cap the 5'-OH of the first base that has not reacted so that it will no longer participate in the reaction;

Step 5: Oxidation of nucleoside phosphites to more stable nucleoside phosphates;

Step 6: Repeat the cycle of Step1~Step5 until the required Oligo DNA sequence is synthesized.

Aminolysis—The synthesized oligonucleotide is chemically cleaved from the solid carrier (CPG), and the protective group is removed by aminolysis.

Purification—The modified primer purification method is as follows:

(1) PAGE purification: use denaturing polyacrylamide gel electrophoresis to separate the primer DNA then the target DNA is recovered from the gel. The purity of the purified DNA is greater than 90%.

74.73±8.67 for AUS1476/AUS1493, 72.36±11.77 for AUS1466/AUS1495. AUS1463, AUS1494, AUS1476/AUS1493, AUS1466/AUS1495 reduce HBV antiviral activity EC50 (nM) value is 2.5~4 fold lower than AUS1233/AUS1138 and have similar cellular toxicity value CC50 (nM) as AUS1233/AUS1138.

| Compounds | AUS1233/AUS1138 | AUS1463 | AUS1494 | AUS1476/AUS1493 | AUS1466/AUS1495 |
|---|---|---|---|---|---|
| EC50 (nM) | 1.45 ± 0.21 | 0.32 ± 0.11 | 0.28 ± 0.09 | 0.24 ± 0.07 | 0.54 ± 0.21 |
| CC50 (nM) | 61.98 ± 9.32 | 57.61 ± 6.14 | 72.91 ± 9.95 | 74.73 ± 8.67 | 72.36 ± 11.77 |

(2) HPLC purification: use the principle of high performance liquid chromatography to purify the primer DNA to a purity greater than 90%.

Example 2: Antiviral Effect of Modified Oligonucleotides in HepG2.2.15 Cells The antiviral effect of modified oligonucleotides was evaluated by measuring the levels of hepatitis B virus (HBV) surface antigen (HBsAg) and HBV e antigen (HBeAg) in HepG2.2.15 cells. The modified oligonucleotides used in this study included AUS1233/AUS1138, AUS1463, AUS1476/AUS1493, AUS1494, AUS1466/AUS1495.

HepG2.2.15 cells that can stably express HBsAg and HBeAg were purchased from China Center for Type Culture Collection (CCTCC No. GDC0141). The modified oligonucleotide solutions were prepared by dissolving each compound in saline or RNase-free double distilled $H_2O$ (dd $H_2O$) to make a target solution at 50 µM.

The modified oligonucleotides worked with HepG2.2.15 cells by reverse transfection. First, a cell suspension with a concentration of $3.5*10^5$ cells in every 100 µl suspension was prepared. The cell culture plate was covered with 30-50 µl Collagen I, Rat Tail (3 mg/mL) (Gibco) in every well. Excess liquid was removed one hour later. P3000 (Invitrogen) and Lipofectamine® 3000 Reagent (Invitrogen) were then diluted with Opti-MEM™ I Reduced Serum Medium (Gibco), mixed with the diluted compound, and then allowed to stand at room temperature for 10 minutes. 10 µl of transfection reagent mixture of P3000, Lipo3000 and Opti-MEM and 100 µl of cell suspension were added to each well. The mixture was pipetted 4 or 5 times and the plate was placed in a 37° C. incubator.

HBsAg levels in the cell supernatant were measured using HBsAg ELISA kits (Lot number: 20201116) were purchased from Autobio Diagnostics (China). HBsAg level was measured according to manufacturer's instructions.

Cell proliferation-toxicity was measured by CCK8 kits. Briefly, the cell supernatant was removed carefully 48 hours after modified oligonucleotide treatment. 100 µl CCK-8 solution according to manufacturer's instructions were added to each well. The plate was placed in a 37° C. incubator for 60 min or 90 min and the absorbance value in each sample was measured by an enzyme-label analyzer (Perlong DNM-9602).

Data for the compounds are provided. The EC50 was 1.45 (nM)+0.21 for AUS1233/AUS1138, 0.32±0.11 for AUS1463, 0.28±0.09 for AUS1494, 0.24±0.07 for AUS1476/AUS1493, 0.54±0.21 for AUS1466/AUS1495, the CC50 (nM) was 61.98±9.32 for AUS1233, AUS1138, 57.61±6.14 for AUS1463, 72.91±9.95 for AUS1494,

Example 3: Antiviral Effect of Modified Oligonucleotides in Genotype C HBV Transgenic Mice This study evaluated the effect of modified oligonucleotides on the serum levels of HBsAg in genotype C HBV (HBV-GTC) transgenic mice. The modified oligonucleotides used in this study included AUS1233/AUS1138, AUS1463, AUS1466/AUS1495, AUS1494, AUS1476/AUS1493, and AUS1441. Each compound was dosed once at 30 mg/kg by subcutaneous injection (SC) to the mice. Normal saline and AUS1233, AUS1138 were administered as negative control and positive control, respectively.

This study evaluated the effect of modified oligonucleotides on the serum levels of HBsAg in genotype C HBV (HBV-GTC) transgenic mice. The modified oligonucleotides used in this study included AUS1233/AUS1138, AUS1463, AUS1466/AUS1495, AUS1494, AUS1476/AUS1493, and AUS1441. Each compound was dosed once at 30 mg/kg by subcutaneous injection (SC) to the mice. Normal saline and AUS1233, AUS1138 were administered as negative control and positive control, respectively.

HBV transgenic mice, prepared from male C57BL/6 mice of 5-7 weeks old with 1.0-fold length of HBV $C_1$ subtype genome, stably express HBsAg in liver. The methods and purposes of animal experiments are in accordance with the ethical standards and international practices.

AUS1233/AUS1138 was used as a reference compound in this study. HBsAg ELISA kits were purchased from Autobio Diagnostics. ELISA was performed using a chemiluminescence immunoassay analyzer (Instrument model: LUMO) at Autobio. Centrifugation of blood was performed with a Preparative Ultracentrifuge by Thermo Fisher Scientific (USA).

The dosing solutions were prepared by dissolving each compound in saline to make a stock solution at 10 mg/ml, which was diluted with saline again at a target concentration of 3 mg/ml.

Figure 4:
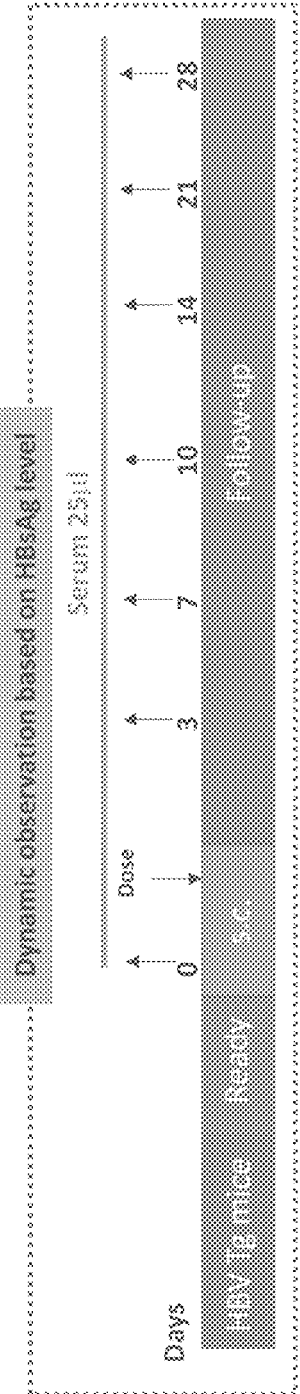
FIG. 4 shows a schematic diagram of a modified oligonucleotide dosing regimen and HBsAg level sampling schedule for HBV Tg mice.

Animal Dosing—The overall study design is shown in the FIG. 4. Male HBV transgenic mice were randomly divided into groups of 4 mice. Each group was dosed with one compound by subcutaneous injection at 30 mg/kg and a dose volume of 10 ml/kg of body weight or an equal volume of normal saline as control.

Approximately 80 µl of blood sample was taken from a thigh vein on 0 (before dosing), 3, 7, 10, 14, 21 and 28 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis.

Serum HBsAg levels in the serum samples were measured using HBsAg ELISA kits (Lot number: 20201116) were purchased from Autobio Diagnostics. Briefly, 50 µl of 10-fold diluted mouse serum or standards was added to a 96-well plate, HBsAg level was measured according to manufacturer's instructions.

The HBsAg levels were measured in the serum samples by ELISA. The maximum log 10 serum HBsAg reduction was −0.494±0.173 for AUS1233, AUS1138, −1.66±0.52 for AUS1463, −1.43±0.12 for AUS1466/AUS1495, −1.22±0.39 for AUS1494, −1.47±0.26 for AUS1476/AUS1493, and −1.48±0.27 for AUS1441. The body weight change was comparable with the saline group for all treatment groups. The results showed that the antiviral effects of the present modified oligonucleotides were much better than the AUS1233, AUS1138.

Example 4: Antiviral Effect of Modified Oligonucleotides in genotypeD HDI-HBV Carrier Mice This study evaluated the effect of modified oligonucleotides on the serum levels of HBsAg in HDI HBV mice. HBV HDI mice model based on the hydrodynamic injection of PreS2/S plasmid into male C57BL/6 mice. The modified oligonucleotides used in this study included AUS1233/ AUS1138, AUS1468, AUS1469, AUS1470, AUS1471, AUS1472, AUS1458, AUS1459, AUS1426, AUS1427/ AUS1461, AUS1462, AUS1463, AUS1464, AUS1465, AUS1466/AUS1495, and AUS1467. Each compound was dosed once at 40 mg/kg by SC. Normal saline and AUS1233, AUS1138 were administered as negative control and positive control, respectively. The HBsAg levels and serum alanine aminotransferase (ALT) levels were measured in the serum samples by ELISA.

This study evaluated the effect of modified oligonucleotides on the serum levels of HBsAg in HDI HBV mice. HBV HDI mice model based on the hydrodynamic injection of PreS2/S plasmid into male C57BL/6 mice. The modified oligonucleotides used in this study included AUS1233/ AUS1138, AUS1468, AUS1469, AUS1470, AUS1471, AUS1472, AUS1458, AUS1459, AUS1426, AUS1427/ AUS1461, AUS1462, AUS1463, AUS1464, AUS1465, AUS1466/AUS1495, and AUS1467. Each compound was dosed once at 40 mg/kg by SC. Normal saline and AUS1233, AUS1138 were administered as negative control and positive control, respectively. The HBsAg levels and serum alanine aminotransferase (ALT) levels were measured in the serum samples by ELISA.

HBsAg ELISA kits were purchased from Autobio Diagnostics (China). ALT ELISA kits were purchased from Elabscience Biotechnology Co., Ltd (China). Normal saline was purchased from Beijing Sanyao Science & Technology Development (China). ELISA was performed using Chemiluminescence immunoassay analyzer of Autobio. Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 4 mg/ml.

Figure 5:
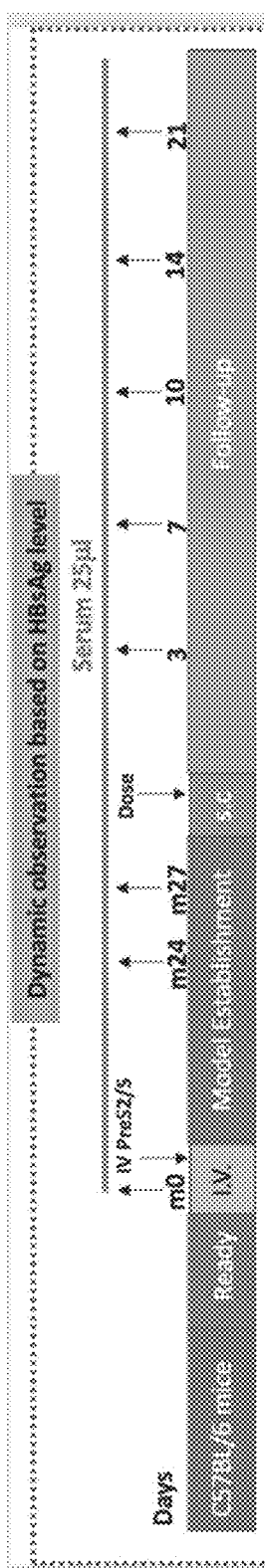
FIG. 5 shows a schematic diagram of a modified oligonucleotide dosing regimen and HBsAg level sampling schedule for C57BL/6 Tg mice.

Animal Dosing—The overall study design is shown in FIG. 5. Male HDI-HBV carrier mice were randomly divided into every group. Each group was dosed with one compound at 40 mg/kg and a dose volume of 10 ml/kg of body weight or an equal volume of normal saline as control. HBsAg-positive mice were dosed 28 days after HDI modeling at the animal laboratory of Eyoung via SC.

Approximately 80 µl of blood sample was taken from a thigh vein on 0 (before dosing), 3, 7, 14 and 21 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis.

Serum HBsAg levels in the serum samples were measured using HBsAg ELISA kits (Lot number: 20201116) were purchased from Autobio Diagnostics (China). Briefly, 50 µl of 25-fold diluted mouse serum or standards was added to a 96-well plate, HBsAg level was measured according to manufacturer's instructions.

Serum ALT levels were measured using ALT ELISA kits (Number: E-BC-K235-M) were purchased from Elabscience Biotechnology Co., Ltd (China). Briefly, 50 µl of 2-fold diluted mouse serum or standards was added to a 96-well plate, HBsAg level was measured according to manufacturer's instructions.

The maximum log 10 serum HBsAg reduction was 1.03±0.23 for AUS1233/AUS1138, and was 2.29±0.25 for AUS1468, 2.26±0.46 for AUS1469, 2.30±0.39 for AUS1470, 2.59±0.39 for AUS1471, 2.59±0.26 for AUS1472, 2.82±0.72 for AUS1458, 2.46±0.52 for AUS1459, 2.57±0.42 for AUS1426, 2.51±0.37 for AUS1427/AUS1461, 2.12±0.21 for AUS1462, 2.03±0.14 for AUS1463, 2.77±1.22 for AUS1464, 2.33±1.10 for AUS1465, 1.90±0.10 for AUS1466/AUS1495 and 1.96±0.35 for AUS1467. The serum ALT levels were <42 IU/L in all samples for all compounds, indicated the liver were not damaged. The body weight change was comparable with the saline group for all treatment groups.

Example 5: Acute Toxic Effect of Modified Oligonucleotides in C57BL/6 Mice

This study evaluated the acute toxic effect of modified oligonucleotides on the serum alanine aminotransferase (ALT) and aspartate aminotransferase (AST) levels in C57BL/6 mice. The modified oligonucleotides used in this study included AUS1233/AUS1138, AUS1472, AUS1427/ AUS1461, AUS1463. Each compound was dosed three times on Day 0, 2, and 4 at 60 mg/kg by subcutaneous injection (SC). Normal saline was used as a negative control. The blood routine was measured in the whole blood samples by HITACHI AUTOMATIC ANALYZER 3100. The alanine aminotransferase (ALT) and aspartate aminotransferase (AST) levels were measured in the serum samples by enzyme-linked immune-sorbent assays (ELISA).

Male C57BL/6 mice were purchased from Shanghai SLAC Laboratory Animal CO., Ltd (China). The mice were maintained under specific pathogen-free condition in the BSL-2+ animal facility of Hagnzhou Eyoung Biotechnology Co., Ltd (China). The methods and purposes of animal experiments are in accordance with the ethical standards and international practices.

ALT and AST ELISA kits were purchased from Elabscience Biotechnology Co., Ltd (China). Normal saline was purchased from Beijing Sanyao Science & Technology Development (China). ELISA was performed using Enzyme Immunoassay Analyzer of Autobio. Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 6 mg/ml.

115

Figure 6:
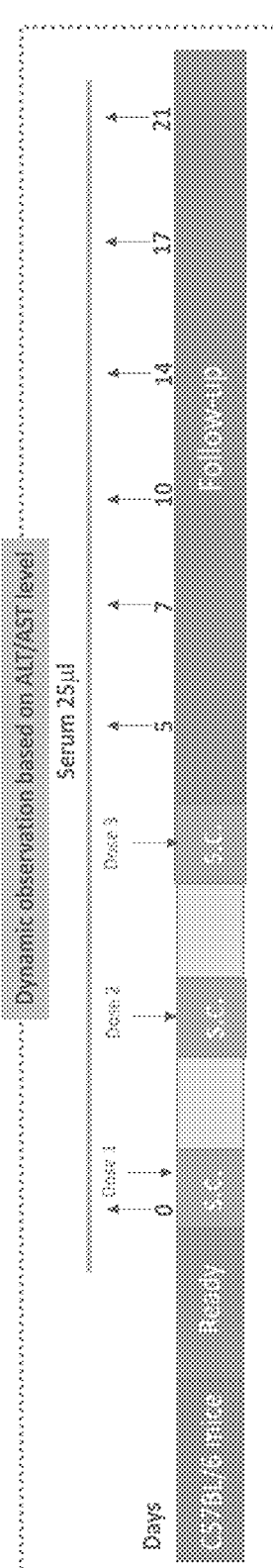
FIG. 6 shows a schematic diagram of a modified oligonucleotide dosing regimen and lanine aminotransferase (ALT) and aspartate aminotransferase (AST) levels sampling schedule for C57BL/6 Tg mice.

The overall study design is shown in FIG. 6. Male C57BL/6 mice were randomly divided into every group. Each compound was dosed three times on Day 0, 2, and 4 at 60 mg/kg by SC and a dose volume of 10 µl/g of body weight or an equal volume of normal saline as control.

Approximately 80 µl of blood sample was taken from a thigh vein on 5, 7, 10, 14, 17 and 21 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis. Approximately 50 µl of blood sample was taken from a thigh vein on Day 17 after dosing. Blood samples were anticoagulated by EDTA-2Na anticoagulant and diluted. The obtained anticoagulant blood dilution samples were stored in a 4° C. refrigerator for blood routine analysis.

Serum ALT levels were measured using ALT ELISA kits (Number: E-BC-K235-M) were purchased from Elabscience Biotechnology Co., Ltd (China). Briefly, 50 µl of 2-fold diluted mouse serum or standards was added to a 96-well plate, HBsAg level was measured according to manufacturer's instructions.

The maximum serum ALT was 53.3 (IU/L)±16.0 for AUS1233/AUS1138, 29.3±8.2 for AUS1472, 44.9±22.0 for AUS1427/AUS1461, 16.1±4.8 for AUS1463. The maximum serum AST (IU/L) was 27.4±7.9 for AUS1233/AUS1138, 18.3±5.5 for AUS1472, 19.0±5.4 for AUS1427/AUS1461, 14.3±3.4 for AUS1463. The ratio of liver and spleen to body weight in all treatment groups was uncomparable with the saline group. The body weight change was comparable with the saline group for all treatment groups. The results of maximum serum ALT and AST show that the modified oligonucleotides have better drug safety than the AUS1233/AUS1138.

Example 6: Antiviral Effect of Modified Oligonucleotides in pAAV-1.2HBV-GTA HDI-HBV Carrier Mice This study evaluated the effect of modified oligonucleotides on the serum levels of HBsAg in HBV transgenic mice. The modified oligonucleotides used in this study included AUS1233/AUS1138, AUS1444, AUS1458, AUS1459, AUS1460, AUS1427/AUS1461, AUS1462, AUS1463, AUS1464, AUS1465, AUS1463, AUS1467, AUS1468, AUS1470, AUS1471, AUS1472, AUS1473, AUS1474, AUS1475, AUS1476/AUS1493, AUS1478, AUS1479, AUS1489, AUS1490, AUS1443, and AUS1322. Each compound was dosed once at 40 mg/kg by SC. Normal saline was administered as negative control. The HBsAg levels were measured in the serum samples by ELISA.

Male C57BL/6 mice were purchased from Shanghai SLAC Laboratory Animal CO., Ltd (China). The HDI-HBV mouse model was constructed by hydrodynamic-injection a pAAV-1.2HBV-GTA plasmid containing 1.2-fold length of HBV sequence. HBsAg-positive mice were used Day 18 after the injection. The mice were maintained under specific pathogen-free condition in BSL-2+ animal facility of Hagnzhou Eyoung biotechnology Co., Ltd (China). The methods and purposes of animal experiments are in accordance with the ethical standards and international practices.

AUS1233/AUS1138 was used as a reference compound in this study. HBsAg ELISA kits were purchased from Autobio Diagnostics (China). Normal saline was purchased from Beijing Sanyao Science & Technology Development (China). ELISA was performed using Chemiluminescence immunoassay analyzer (Instrument model: LUMO) of Autobio. Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 4 mg/ml.

Figure 7:
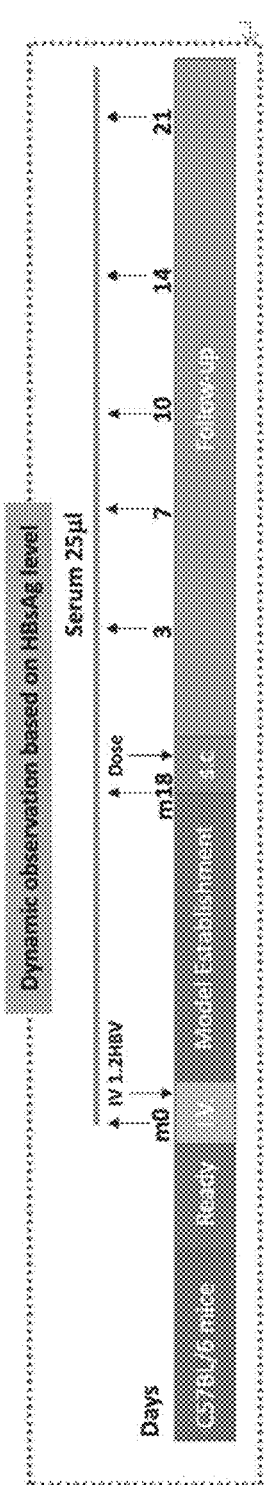
FIG. 7 shows a schematic diagram of a modified oligonucleotide dosing regimen and HBsAg level sampling schedule for pAAV-1.2HBV-GTA HDI-HBV mice.

Animal Dosing: The overall study design is shown in FIG. 7. Male HDI-HBV carrier mice were randomly divided into each group. Each group was dosed with one compound at 40 mg/kg and a dose volume of 10 ml/kg of body weight or an equal volume of normal saline as control. HBsAg-positive mice were dosed 18 days after HDI modeling at the animal laboratory of Eyoung via SC.

Approximately 80 µl of blood sample was taken from a thigh vein on 0 (before dosing), 3, 7, 10, 14 and 21 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis.

Serum HBsAg levels in the serum samples were measured using HBsAg ELISA kits (Lot number: 20201116) were purchased from Autobio Diagnostics (China). Briefly, 50 µl of 25-fold diluted mouse serum or standards was added to a 96-well plate, HBsAg level was measured according to manufacturer's instructions.

The maximum log 10 serum HBsAg reduction was −0.774±0.111 for AUS1233/AUS1138, −3.61±1.65 for AUS1444, −2.72±1.24 for AUS1458, −1.27±0.21 for AUS1459, −2.06±1.78 for AUS1460, −1.21±0.35 for AUS1427/AUS1461, −2.09±2.23 for AUS1462, −2.06±0.05 for AUS1463, −1.70±1.39 for AUS1464, −2.09±1.70 for AUS1465, −1.38±0.53 for AUS1463, −2.80±2.11 for AUS1467, −0.844±0.262 for AUS1468, −0.910±0.259 for AUS1470, −0.814±0.156 for AUS1471, −1.95±1.60 for AUS1472, −1.87±1.82 for AUS1473, −1.59±1.73 for AUS1474, −3.06±0.85 for AUS1475, −2.79±1.63 for AUS1476/AUS1493, −1.16±0.94 for AUS1478, −0.903±0.164 for AUS1479, −1.64±0.18 for AUS1489, −1.58±1.15 for AUS1490, −2.94±0.78 for AUS1443, and −3.10±0.70 for AUS1322. The body weight change was comparable with the saline group for all treatment groups. The results showed that the antiviral effects of the modified oligonucleotides were much better than the AUS1233/AUS1138.

Example 7: Acute Toxicity Test of Modified Oligonucleotides in C57BL/6 Mice

This study evaluated the acute toxic effect of modified oligonucleotides on the serum alanine aminotransferase (ALT) levels in C57BL/6 mice. The modified oligonucleotides used in this study included AUS1233/AUS1138, AUS1322, AUS1465, AUS1466/AUS1495, AUS1467, AUS1468, AUS1469, AUS1470, AUS1471, AUS1472, AUS1473, AUS1474, AUS1475, AUS1476/AUS1493, AUS1477, AUS1478, AUS1479, AUS1488/AUS1497, AUS1489, AUS1490. Each compound was dosed three times on Day 0, 2, and 4 at 60 mg/kg by SC. Normal saline was administered as negative control. The ALT levels were measured in the serum samples by enzyme-linked immunesorbent assays (ELISA).

Male C57BL/6 mice were purchased from Shanghai SLAC Laboratory Animal CO., Ltd (China). The mice were maintained under specific pathogen-free condition in the BSL-2+ animal facility of Hagnzhou Eyoung Biotechnology Co., Ltd (China). The methods and purposes of animal experiments are in accordance with the ethical standards and international practices.

ALT ELISA kits were purchased from Elabscience Bio-technology Co., Ltd (China). Normal saline was purchased from Beijing Sanyao Science & Technology Development (China). ELISA was performed using Enzyme Immunoassay Analyzer of Autobio. Centrifugation of blood was per-formed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 6 mg/ml.

Figure 8:
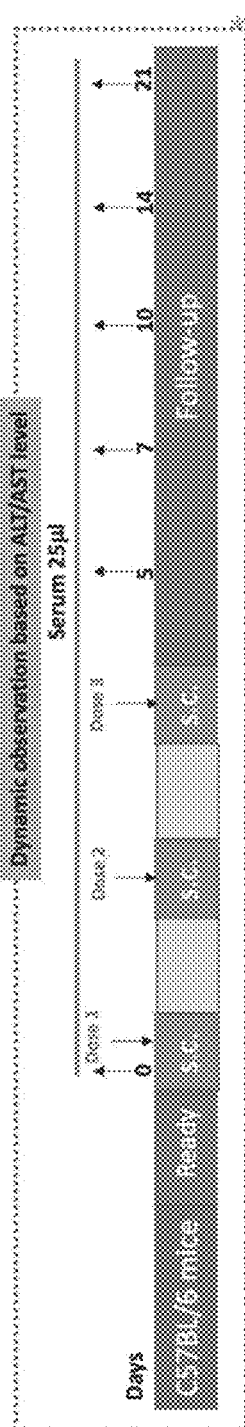
FIG. 8 shows a schematic diagram of a modified oligonucleotide dosing regimen and lanine aminotransferase (ALT) and aspartate aminotransferase (AST) levels sampling schedule for C57BL/6 Tg mice.

The overall study design is shown in FIG. 8. Male C57BL/6 WT mice were randomly divided into each group. Each group was dosed with one compound of triple doses at 60 mg/kg and a dose volume of 10 ml/kg of body weight or an equal volume of normal saline as control. All mice were dosed at the animal laboratory of Eyoung via SC.

Approximately 80 µl of blood sample was taken from a thigh vein on 5, 7, 10, 14, 17 and 21 days after dosing. Blood samples were placed in an incubator at 37° C. for approxi-mately 30 minutes, and then centrifuged in a precooled (0-4° C.) centrifuge to obtain the serum samples. The obtained serum samples were stored in a −20° C. refrigerator for further analysis.

The maximum serum ALT levels was 30.4±14.8 for AUS1233/AUS1138, 335±13 for AUS1322, 10.7±0.5 for S, 10.6±1.4 for AUS1466/AUS1495, 11.8±0.9 for AUS1467, 11.8±3.8 for AUS1468, 9.16±1.69 for AUS1469, 12.5±1.1 for AUS1470, 11.8±2.3 for AUS1471, 12.5±1.1 for AUS1472 16.6±8.3 for AUS1473, 12.8±2.5 for AUS1474, 13.5±2.4 for AUS1475, 14.7±2.6 for AUS1476/AUS1493, 15.1±1.1 for AUS1477 14.2±0.6 for AUS1478 13.1±3.7 for AUS1479, 10.3±1.3 for AUS1488/AUS1497, 14.6±4.5 for AUS1489, 58.4±13.5 for AUS1490. The body weight change was comparable with the saline group for all treat-ment groups except AUS1322. AUS1322 declined on Day 14 for 3.75%. The results of the maximum serum ALT levels show that the safety of the modified oligonucleotides are much better than the AUS1233/AUS1138.

Example 8: Antiviral Effect of Modified Oligonucleotides in pcDNA3.1-preS2-GTD HDI-HBV Mice This study evaluated the effect of modified oligonucle-otides on the serum levels of HBsAg in HDI-HBV GTD carrier mice. The modified oligonucleotides used in this study included AUS1233/AUS1138, AUS1463, AUS1476/AUS1493. Each compound was dosed once at 15 or 45 mg/kg by SC. Normal saline was administered as negative control. The HBsAg levels were measured in the serum samples by ELISA.

Male C57BL/6 mice were purchased from Shanghai SLAC Laboratory Animal CO., Ltd (China). The HDI-HBV mouse model was constructed by hydrodynamic-injection a pcDNA3.1-preS2-GTD plasmid containing preS2 of HBV sequence. HBsAg-positive mice were used Day 23 after the injection. The mice were maintained under specific patho-gen-free conditions in the BSL-2+ animal facility of Hag-nzhou Eyoung biotechnology Co., Ltd (China). The methods and purposes of animal experiments are in accordance with the ethical standards and international practices.

HBsAg ELISA kits were purchased from Autobio Diag-nostics (China). Normal saline was purchased from Beijing Sanyao Science & Technology Development (China). ELISA was performed using Chemiluminescence immuno-assay analyzer (Instrument model: LUMO) of Autobio. Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 1.5 and 4.5 mg/ml.

The overall study design is shown in FIG. 9. Male HDI-HBV GTD carrier mice were randomly divided into each group. Each group was dosed with one compound at 15 or 45 mg/kg and a dose volume of 10 ml/kg of body weight or an equal volume of normal saline as control. HBsAg-positive mice were dosed 23 days after HDI modeling at the animal laboratory of Eyoung via SC.

Approximately 80 µl of blood sample was taken from a thigh vein on 0 (before dosing), 3, 7, 10, 14, 21 and 26 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis.

Serum HBsAg levels in the serum samples were measured using HBsAg ELISA kits (Lot number: 20201116) were purchased from Autobio Diagnostics (China). Briefly, 50 µl of 25-fold diluted mouse serum or standards was added to a 96-well plate, HBsAg level was measured according to manufacturer's instructions.

The maximum log 10 serum HBsAg reduction was −0.482±0.153 log 10 for AUS1233/AUS1138 (15), −0.917±0.258 for AUS1463 (15), −0.891±0.107 for AUS1476/AUS1493 (15), −1.95±1.13 for AUS1233/AUS1138 (45), −2.04±0.28 for AUS1463 (45), and −1.86±0.19 for AUS1476/AUS1493 (45). The body weight change was comparable with the saline group for all treat-ment groups. The results showed that the antiviral effects of modified oligonucleotides (AUS1463 & AUS1476/AUS1493) were equal or better than the AUS1233/AUS1138 in GTD HDI-HBV mice.

Example 9: Antiviral Effect of Modified Oligonucleotides in pcDNA3.1-preS2-GTA HDI-HBV Carrier Mice This study evaluated the effect of modified oligonucle-otides on the serum levels of HBsAg in HDI-HBV carrier mice. The modified oligonucleotides used in this study included AUS1233/AUS1138 & AUS1476/AUS1493. Each compound was dosed once at 15 or 45 mg/kg by SC. Normal saline was administered as negative control. The HBsAg levels were measured in the serum samples by ELISA.

Male C57BL/6 mice were purchased from Shanghai SLAC Laboratory Animal CO., Ltd (China). The HDI-HBV mouse model was constructed by hydrodynamic-injection a pcDNA3.1-preS2-GTA plasmid containing preS2 of HBV sequence. HBsAg-positive mice were used Day 23 after the injection. The mice were maintained under specific patho-gen-free condition in the BSL-2+ animal facility of Hag-nzhou Eyoung Biotechnology Co., Ltd (China). The meth-ods and purposes of animal experiments are in accordance with the ethical standards and international practices.

HBsAg ELISA kits were purchased from Autobio Diag-nostics (China). Normal saline was purchased from Beijing Sanyao Science & Technology Development (China). ELISA was performed using Chemiluminescence immuno-assay analyzer (Instrument model: LUMO) of Autobio.

Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 1.5 and 4.5 mg/ml.

The overall study design is shown in FIG. 10. Male HDI-HBV carrier mice were randomly divided into each group. Each group was dosed with one compound at 15 or 45 mg/kg and a dose volume of 10 ml/kg of body weight or an equal volume of normal saline as control. HBsAg-positive mice were dosed 23 days after HDI modeling at the animal laboratory of Eyoung via SC.

Approximately 80 μl of blood sample was taken from a thigh vein on 0 (before dosing), 3, 7, 10, 14, 21 and 26 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis.

Serum HBsAg levels in the serum samples were measured using HBsAg ELISA kits (Lot number: 20201116) were purchased from Autobio Diagnostics (China). Briefly, 50 μl of 20-fold diluted mouse serum or standards was added to a 96-well plate, HBsAg level was measured according to manufacturer's instructions.

The maximum log 10 serum HBsAg reduction was −0.304±0.077 log 10 for AUS1233/AUS1138 (15), −0.592±0.094 for AUS1476/AUS1493 (15), −0.842±0.127 for AUS1233, AUS1138 (45), and −1.76±0.10 for AUS1476/AUS1493 (45). The body weight change was comparable with the saline group for all treatment groups. The results showed that the efficacy of different doses of AUS1476/AUS1493 were better than the AUS1233/AUS1138 in GTA HDI-HBV carrier mice.

Example 10: Antiviral Effect of Modified Oligonucleotides in Genotype a HBV Transgenic Mice This study evaluated the effect of modified oligonucleotides on the serum levels of HBsAg in HBV transgenic mice. The modified oligonucleotides used in this study included AUS1233/AUS1138 and AUS1476/AUS1493. Each compound was dosed once at 45 mg/kg by SC. Normal saline and AUS1233/AUS1138 were administered as negative control and positive control, respectively. The HBsAg levels and HBeAg levels were measured in the serum samples by enzyme-linked immune-sorbent assays (ELISA). The maximum log 10 serum HBsAg reduction was −1.768±0.16 log 10 for AUS1233/AUS1138, and −2.483±0.27 for AUS1476/AUS1493. The body weight change was comparable with the saline group for all treatment groups.

HBV transgenic mice, prepared from male and female C57BL/6 mice of 5-7 weeks old with 1.2-fold length of HBV A subtype genome, stably express HBsAg in liver. The mice were obtained from Xiamen University and bred under specific pathogen-free condition in the BSL-2+ animal facility of Zhejiang Chinese Medical University (China). The methods and purposes of animal experiments are in accordance with the ethical standards and international practices.

HBsAg ELISA kits were purchased from Autobio Diagnostics (China). HBeAg ELISA kits were purchased from Beijing BGI-BGIN Biotech (China). Normal saline was purchased from Beijing Sanyao Science & Technology Development (China). ELISA was performed using Chemiluminescence immunoassay analyzer (Instrument model: LUMO) of Autobio and Microplate reader of Pulangbio. Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 4.5 mg/ml.

The overall study design is shown in FIG. 11. Male and female HBV transgenic mice were randomly divided into each group. Each group was dosed with one compound at 45 mg/kg and a dose volume of 10 ml/kg of body weight or an equal volume of normal saline as control. All mice were dosed at the animal laboratory of Eyoung via SC.

Approximately 80 μl of blood sample was taken from a thigh vein on 0 (before dosing), 3, 7, 10, 14, 21 and 29 days after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further analysis.

Serum HBsAg levels in the serum samples were measured using HBsAg ELISA kits (Lot number: 20201116) were purchased from Autobio Diagnostics (China). Briefly, 50 μl of 20-fold diluted mouse serum or standards was added to a 96-well plate, HBsAg level was measured according to manufacturer's instructions.

The maximum log 10 serum HBsAg reduction was −1.79±0.16 log 10 for AUS1233/AUS1138, −2.25±0.28 for AUS1463, and −2.21±0.27 for AUS1476/AUS1493. The results showed that the efficacy of AUS1476/AUS1493 is better than the AUS1233/AUS1138 in GTA HBV transgenic mice.

Example 11: Antiviral Effect of Modified Oligonucleotides in AAV-HBV Carrier Mice (GTD)

This study evaluated the effect of modified oligonucleotides on the serum levels of HBsAg in AAV HBV mice. HBV HDI mice model based on the injection of AAV-HBV plasmid into male C57BL/6 mice. The modified oligonucleotides used in this study included AUS1233/AUS1138 and AUS1476/AUS1493. Each compound was dosed once at 15 mg/kg, 45 mg/kg and 90 mg/kg respectively by SC. Normal saline and AUS1233/AUS1138 were administered as negative control and positive control, respectively. The HBsAg, HBeAg and ALT levels was measured in the serum samples by ELISA. The HBV DNA levels was measured in the serum samples by real-time PCR using a Taqman probe.

Male AAV HBV-GTD C57BL/6 mice were from The First Hospital of Zhejiang University. The HDI-HBV mouse model was constructed by injection a $1 \times 10^{11}$ vg AAV-GTD plasmid containing HBV sequence. The mice were maintained under specific pathogen-free condition in the BSL-2+ animal facility of The First Hospital of Zhejiang University. The methods and purposes of animal experiments are in accordance with the ethical standards and international practices.

HBsAg ELISA kits were purchased from Autobio Diagnostics (China). ALT and AST ELISA kits were purchased from Elabscience Biotechnology Co., Ltd (China). Normal saline was purchased from Beijing Sanyao Science & Technology Development (China). ELISA was performed using Chemiluminescence immunoassay analyzer (Instrument model: LUMO) of Autobio. Centrifugation of blood was performed with a Preparative Ultracentrifuge of Thermo Fisher Scientific (USA).

The dosing solutions were prepared by dissolving each compound in saline to make a stock solution at 10 mg/ml, which was diluted with saline again at a target concentration of 1.5 mg/ml, 4.5 mg/ml and 9 mg/ml.

Animal Dosing. The overall study design is shown in FIG. 12. Male AAV-HBV carrier mice were randomly divided into each group. Mice were dosed with one compound at 15 mg/kg, 45 mg/kg and 90 mg/kg respectively. A dose volume of 10 ml/kg of body weight or an equal volume of normal saline as control.

Approximately 80 µl of blood sample was taken from a thigh vein on 0 (before dosing), 3, 7, 10, 14, 21 and 28 days after dosing. Blood samples were placed in an incubator at 37° C. for approximately 30 minutes, and then centrifuged in a precooled (0-4° C.) centrifuge to obtain the serum samples. The obtained serum samples were stored in a –20° C. refrigerator for further analysis.

Serum HBsAg levels in the serum samples were measured using HBsAg ELISA kits (Lot number: 20201116) were purchased from Autobio Diagnostics (China). Briefly, 50 µl of 20-fold diluted mouse serum or standards was added to a 96-well plate, HBsAg level was measured according to manufacturer's instructions.

The maximum log 10 serum HBsAg reduction was –0.413±0.309 log 10 for AUS1233/AUS1138 (15), –0.736±0.481 for AUS1476/AUS1493 (15), –1.274±0.456 for AUS1233/AUS1138 (45), –1.713±0.585 for AUS1476/AUS1493, –1.724±0.194 for AUS1233/AUS1138 (90), –2.394±0.408 for AUS1476/AUS1493. The results showed that the efficacy of AUS1476/AUS1493 is better than the AUS1233/AUS1138 in AAV-HBV carrier mice (GTD).

Example 12: Acute Toxic Effect of Modified Oligonucleotides in C57BL/6 Mice

This study evaluated the acute toxic effect of modified oligonucleotides on the serum ALT and AST levels in C57BL/6 mice. The modified oligonucleotides used in this study included AUS1233/AUS1138, AUS1463, AUS1476/AUS1493. Each compound was dosed three times on Day 0, 2, and 4 at 60 mg/kg by SC. Normal saline was used as a negative control. The blood routine was measured in the whole blood samples by HITACHI AUTOMATIC ANA-LYZER 3100. The ALT and AST levels were measured in the serum samples by ELISA.

Male C57BL/6 mice were purchased from Shanghai SLAC Laboratory Animal CO., Ltd (China). The mice were maintained under specific pathogen-free condition in the BSL-2+ animal facility of Hagnzhou Eyoung Biotechnology Co., Ltd (China). The methods and purposes of animal experiments are in accordance with the ethical standards and international practices.

ALT and ELISA kits were purchased from Elabscience Biotechnology Co., Ltd (China). Normal saline was purchased from Beijing Sanyao Science & Technology Development (China). ELISA was performed using Enzyme Immunoassay Analyzer of Autobio. Centrifugation of blood was performed with a Preparative Ultracentrifuge of Thermo Fisher Scientific (USA).

The dosing solutions were prepared by dissolving each compound in saline to make a stock solution at 20 mg/ml, which was diluted with saline again at a target concentration of 6 mg/ml and 15 mg/ml.

Animal Dosing—The overall study design is shown in FIG. 13. Male C57BL/6 mice were randomly divided into each group. Each compound was dosed three times on Day 0, 2, and 4 at 60 mg/kg by subcutaneous injection (SC) and a dose volume of 10 µl/g of body weight or an equal volume of normal saline as control.

Approximately 80 µl of blood sample was taken from a thigh vein on 7, 14, 17, 21 and 27 days after dosing. Blood samples were placed in an incubator at 37° C. for approximately 30 minutes, and then centrifuged in a precooled (0-4° C.) centrifuge to obtain the serum samples. The obtained serum samples were stored in a –20° C. refrigerator for further analysis.

Approximately 50 µl of blood sample was taken from a thigh vein on Day 17 after dosing. Blood samples were anticoagulated by EDTA-2Na anticoagulant and diluted. The obtained anticoagulant blood dilution samples were stored in a 4° C. refrigerator for blood routine analysis.

Assays—Serum ALT levels were measured using ALT ELISA kits (Number: E-BC-K235-M) were purchased from Elabscience Biotechnology Co., Ltd (China). Briefly, 50 µl of 2-fold diluted mouse serum or standards was added to a 96-well plate, HBsAg level was measured according to manufacturer's instructions.

The results of serum ALT and AST levels show the present modified oligonucleotides have a higher safety level than the AUS1233/AUS1138.

Example 13: Antiviral Effect of eASO Compounds in HepG2.2.15 Cells

The antiviral effect of eASO compounds was evaluated by measuring the levels of hepatitis B virus (HBV) surface antigen (HBsAg) and HBV e antigen (HBeAg) in HepG2.2.15 cells. The HBsAg levels were measured by chemiluminescence immunoassays, the HBeAg levels were measured by ELISA assays and cell viability was determined by MTT cell proliferation assay. The calculation result was expressed as mean and SD.

HepG2.2.15 cells that can stably express HBsAg and HBeAg were purchased from China Center for Type Culture Collection (CCTCC No. GDC0141). The eASO compound solutions were prepared by dissolving each compound in saline or RNase-free double distilled H2O (dd H2O) to make a target stock solution at 50 µM.

The eASO compounds were set in a series of concentrations (0, 0.037, 0.11, 0.34, 1, 3.1, 9.3, 27.8, 83.3, 250 nM) and worked with HepG2.2.15 cells by reverse transfection. First, the 96-well cell culture plate was covered with 50 µl Rat Tail Collagen I in every well and removed one hour later. Second, P3000 and Lipofectamine® 3000 Reagent was diluted with Opti-MEM™ reduced serum medium and mixed with the serial dilution compound solution, followed by incubation at room temperature for 10 minutes. Third, 10 µl of transfection reagent mixture of P3000, Lipo3000 and eASO and 100 µl of cell suspension with a concentration of $3.5*10^5$ cells were added to each well.

The mixture was pipetted 4 or 5 times and the plate was placed in a 37° C. incubator. After reverse transfection 24 h, the media was exchanged with fresh cell culture medium. Following a 48 h culture, supernatant was collected for detection. The remaining cells were used for cell viability test. The resulting data is represented in Table 14.1, as EC50 (nM) and MTT CC25 (nM). The EC50 (nM) ratio was calculated by dividing the EC50 value determined following the treatment with the modified oligonucleotide of any one of AUS1010 to AUS1714 (SEQ ID NOs: 11 to 666) by the EC50 value determined following the treatment with a reference oligonucleotide of AUS1233 (SEQ ID NO: 10). A lower EC50 ratio value suggests the increased ability of the modified oligonucleotide to decrease HBsAg levels relative to the reference oligonucleotide. The MTT CC25 (nM) ratio was calculated by dividing the MTT CC25 value determined following treatment with the modified oligonucleotide of any one of AUS1010 to AUS1714 (SEQ ID NOs: 11 to 666) by the MTT CC25 value determined following the treatment with a reference oligonucleotide of AUS1233 (SEQ ID NO: 10). A higher MTT CC25 ratio suggests an increased cellular viability relative to the reference oligonucleotide. The C/E ratio was calculated by dividing the MTT CC25 ratio value by the EC50 value. A higher C/E ratio suggests a balanced decrease in HBsAg levels while maintaining high cellular viability.

Example 14: Antiviral Effect of eASO Compounds in HepG2.2.15 Cells

The antiviral effect of eASO compounds was evaluated by measuring the levels of hepatitis B virus (HBV) surface antigen (HBsAg) and HBV e antigen (HBeAg) in HepG2.2.15 cells. The HBsAg levels were measured by Chemiluminescence immunoassay assays, the HBeAg levels were measured by ELISA assays and cell viability was determined by CCK-8 cell proliferation assay. The calculation result was expressed as mean and SD.

HepG2.2.15 cells that can stably express HBsAg and HBeAg were purchased from China Center for Type Culture Collection (CCTCC No. GDC0141). The eASO compound solutions were prepared by dissolving each compound in saline or RNase-free double distilled H2O (dd H2O) to make a target stock solution at 50 μM.

The eASO compounds were set in a series of concentrations (0, 0.037, 0.11, 0.34, 1, 3.1, 9.3, 27.8, 83.3, 250 nM) and worked with HepG2.2.15 cells by reverse transfection. First, the 96-well cell culture plate was covered with 50 μl Rat Tail Collagen I in every well and removed one hour later. Second, P3000 and Lipofectamine® 3000 Reagent were diluted with Opti-MEM™ reduced serum medium and mixed with the serial dilution compound solution, and allowed to incubate at room temperature for 10 minutes. Third, 10 μl of transfection reagent mixture of P3000, Lipo3000 and eASO and 100 μl of cell suspension with a concentration of $3.5*10^5$ cells were added to each well. The mixture was pipetted 4 or 5 times and the plate was placed in a 37° C. incubator. After reverse transfection 24 h, media was exchanged with fresh cell culture medium. After 48 h supernatant was collected for HBsAg detection. For cell viability test, cell supernatant was removed after reverse transfection 48 h, and the CCK-8 reagent was added to detect the absorbance. The resulting data is represented in Table 14.1, EC50 (nM) ratio was calculated by dividing the EC50 value determined following the treatment with the modified oligonucleotide of any one of AUS1010 to AUS1714 (SEQ ID NOs: 11 to 666) by the EC50 value determined following the treatment with a reference oligonucleotide of AUS1233 (SEQ ID NO: 10). A lower EC50 ratio value suggests the increased ability of the modified oligonucleotide to decrease HBsAg levels relative to the reference oligonucleotide. The ratio of CCK8 CC30 was calculated by dividing the CCK8 CC30 value determined following treatment with the modified oligonucleotide of any one of AUS1010 to AUS1714 (SEQ ID NOs: 11 to 666) by the CCK8 CC30 value determined following the treatment with a reference oligonucleotide of AUS1233 (SEQ ID NO: 10). A higher CCK8 CC30 ratio suggests an increased cellular viability relative to the reference oligonucleotide. The C/E ratio was calculated by dividing the CCK8 CC30 ratio value by the EC50 value. A higher C/E ratio suggests a balanced decrease in HBsAg levels while maintaining high cellular viability.

TABLE 14.1

Antiviral effect of eASO compounds in HepG2.2.15 cells by MMT and/or CCK8 proliferation assays

| SEQ ID NO: | ID | Ratio $EC_{50}$ | Ratio MTT CC25 or CCK8 CC30 | C/E ratio |
|---|---|---|---|---|
| 12 | AUS1011 | 2.9 | 0.1 | 0.050 |
| 13 | AUS1012 | >250 | >250 | |
| 14 | AUS1013 | 39.19 | >250 | |
| 15 | AUS1014 | >250 | >250 | |
| 16 | AUS1015 | 1.84 | >250 | |
| 18 | AUS1017 | 5.5 | 2.6 | 0.47 |
| 33 | AUS1036 | 10.75 | 2.30 | 0.21 |
| 34 | AUS1037 | 1.69 | 2.23 | 1.32 |
| 35 | AUS1038 | 1.53 | 1.39 | 0.9 |
| 36 | AUS1039 | 8.14 | 2.35 | 0.29 |
| 37 | AUS1042 | 2.38 | 1.57 | 0.66 |
| 38 | AUS1043 | 1.41 | 1.51 | 1.07 |
| 39 | AUS1044 | 2.47 | 1.09 | 0.44 |
| 40 | AUS1045 | 3.09 | 1.49 | 0.48 |
| 41 | AUS1046 | 3.65 | 2.13 | 0.58 |
| 42 | AUS1049 | 1.42 | 2.11 | 1.49 |
| 43 | AUS1050 | 0.90 | 1.65 | 1.83 |
| 44 | AUS1051 | 1.66 | 2.14 | 1.30 |
| 45 | AUS1052 | 1.54 | 1.18 | 0.77 |
| 46 | AUS1053 | 1.86 | 1.16 | 0.62 |
| 47 | AUS1054 | 2.16 | 0.89 | 0.41 |
| 48 | AUS1055 | 2.25 | 0.54 | 0.24 |
| 49 | AUS1056 | 2.32 | 1.51 | 0.65 |
| 50 | AUS1057 | 1.33 | 0.80 | 0.60 |
| 51 | AUS1058 | 1.64 | 0.95 | 0.58 |
| 52 | AUS1059 | 2.14 | 0.75 | 0.35 |
| 53 | AUS1060 | 2.19 | 1.33 | 0.61 |
| 54 | AUS1061 | 1.05 | 0.82 | 0.78 |
| 55 | AUS1062 | 2.84 | 2.09 | 0.74 |
| 56 | AUS1063 | 5.26 | 1.88 | 0.36 |
| 57 | AUS1064 | 6.19 | 2.45 | 0.40 |
| 58 | AUS1065 | 2.50 | 1.66 | 0.66 |
| 59 | AUS1066 | 2.50 | 2.28 | 0.91 |
| 60 | AUS1067 | 3.67 | 1.60 | 0.44 |
| 61 | AUS1068 | 2.61 | 1.50 | 0.57 |
| 62 | AUS1069 | 1.72 | 1.11 | 0.64 |
| 63 | AUS1070 | 1.90 | 1.43 | 0.75 |
| 64 | AUS1071 | 2.54 | 2.34 | 0.92 |
| 65 | AUS1072 | 2.80 | 2.36 | 0.84 |
| 66 | AUS1073 | 1.65 | 1.20 | 0.72 |
| 67 | AUS1074 | 3.41 | 1.03 | 0.30 |
| 68 | AUS1075 | 5.06 | | |
| 69 | AUS1076 | 1.55 | | |
| 70 | AUS1077 | 1.83 | | |
| 71 | AUS1078 | 2.66 | 1.26 | 0.48 |
| 72 | AUS1079 | 3.94 | 1.45 | 0.37 |
| 73 | AUS1081 | 2.95 | 1.20 | 0.41 |
| 74 | AUS1082 | 2.03 | 0.54 | 0.27 |
| 75 | AUS1083 | 1.98 | 0.69 | 0.35 |
| 76 | AUS1084 | 3.71 | >250 | |
| 77 | AUS1085 | 2.41 | >250 | |
| 78 | AUS1086 | 3.68 | >250 | |
| 79 | AUS1087 | 5.59 | >250 | |
| 80 | AUS1088 | 4.93 | >250 | |
| 81 | AUS1089 | 2.81 | >250 | |
| 82 | AUS1090 | 2.07 | >250 | |
| 83 | AUS1091 | 2.08 | 0.94 | 0.45 |
| 84 | AUS1092 | 9.62 | >250 | |
| 85 | AUS1093 | 7.07 | >250 | |
| 86 | AUS1094 | 2.83 | >250 | |
| 87 | AUS1095 | 2.42 | >250 | |
| 88 | AUS1096 | 1.87 | >250 | |
| 89 | AUS1097 | 1.59 | >250 | |
| 90 | AUS1098 | 1.70 | >250 | |
| 91 | AUS1099 | 1.55 | >250 | |
| 92 | AUS1100 | 1.75 | >250 | |
| 93 | AUS1101 | 5.73 | >250 | |
| 94 | AUS1102 | 17.14 | >250 | |

TABLE 14.1-continued

Antiviral effect of eASO compounds in HepG2.2.15 cells
by MMT and/or CCK8 proliferation assays

| SEQ ID NO: | ID | Ratio EC$_{50}$ | Ratio MTT CC25 or CCK8 CC30 | C/E ratio |
|---|---|---|---|---|
| 96 | AUS1105 | 1.24 | 0.88 | 0.71 |
| 97 | AUS1106 | 1.80 | 1.06 | 0.59 |
| 98 | AUS1107 | 2.63 | 1.37 | 0.52 |
| 99 | AUS1108 | 1.78 | 0.93 | 0.52 |
| 100 | AUS1109 | 1.21 | 0.85 | 0.71 |
| 101 | AUS1110 | 2.16 | 1.14 | 0.53 |
| 102 | AUS1111 | 2.66 | 1.64 | 0.62 |
| 103 | AUS1112 | 2.18 | 1.13 | 0.52 |
| 104 | AUS1113 | 1.82 | 1.13 | 0.62 |
| 105 | AUS1114 | 1.66 | 1.09 | 0.66 |
| 106 | AUS1116 | 2.40 | 1.24 | 0.52 |
| 107 | AUS1117 | 1.94 | 1.11 | 0.57 |
| 108 | AUS1118 | 1.93 | 1.31 | 0.68 |
| 109 | AUS1119 | 1.92 | 0.97 | 0.50 |
| 110 | AUS1120 | 2.89 | 0.72 | 0.25 |
| 111 | AUS1121 | 3.15 | 3.54 | 1.12 |
| 112 | AUS1122 | 3.12 | 0.54 | 0.17 |
| 113 | AUS1123 | 2.31 | 0.98 | 0.42 |
| 114 | AUS1124 | 1.02 | 0.59 | 0.58 |
| 115 | AUS1125 | 2.08 | 1.45 | 0.69 |
| 116 | AUS1126 | 1.19 | 0.82 | 0.69 |
| 117 | AUS1127 | 1.43 | 0.76 | 0.53 |
| 118 | AUS1128 | 1.46 | 0.90 | 0.62 |
| 119 | AUS1129 | 1.62 | 1.02 | 0.63 |
| 120 | AUS1130 | 1.68 | 0.85 | 0.50 |
| 121 | AUS1131 | 2.06 | 0.92 | 0.45 |
| 122 | AUS1132 | 4.88 | 2.41 | 0.49 |
| 123 | AUS1133 | 3.15 | 1.16 | 0.37 |
| 124 | AUS1134 | 1.55 | 0.89 | 0.57 |
| 125 | AUS1135 | 1.68 | 0.90 | 0.54 |
| 126 | AUS1136 | 1.54 | 0.87 | 0.57 |
| 127 | AUS1137 | 1.63 | 0.80 | 0.49 |
| 132 | AUS1143 | 1.28 | 0.81 | 0.63 |
| 133 | AUS1144 | 2.16 | 0.66 | 0.31 |
| 134 | AUS1145 | 1.95 | 0.64 | 0.33 |
| 135 | AUS1146 | 2.15 | 0.60 | 0.28 |
| 136 | AUS1147 | 2.14 | 0.59 | 0.27 |
| 137 | AUS1148 | 1.93 | 0.98 | 0.51 |
| 138 | AUS1149 | 1.80 | 0.83 | 0.46 |
| 139 | AUS1151 | 1.11 | 0.82 | 0.74 |
| 140 | AUS1152 | 2.43 | 1.43 | 0.59 |
| 141 | AUS1153 | 3.35 | 1.58 | 0.47 |
| 142 | AUS1154 | 2.67 | 3.05 | 1.14 |
| 143 | AUS1156 | 9.465422 | 2.729780304 | 0.288395 |
| 144 | AUS1157 | 9.9710755 | 2.654861737 | 0.266256 |
| 145 | AUS1158 | 23.050224 | 3.163074364 | 0.137225 |
| 146 | AUS1159 | 19.57928 | 2.076928408 | 0.106078 |
| 147 | AUS1160 | 15.571917 | 2.499341604 | 0.160503 |
| 148 | AUS1161 | 32.027347 | 2.46586735 | 0.076993 |
| 149 | AUS1162 | 9.5 | 2.7 | 0.29 |
| 150 | AUS1163 | 10.0 | 2.7 | 0.27 |
| 151 | AUS1164 | 23.1 | 3.2 | 0.14 |
| 152 | AUS1165 | 19.6 | 2.1 | 0.11 |
| 154 | AUS1168 | 3.63 | 1.11 | 0.31 |
| 155 | AUS1169 | 2.90 | 1.17 | 0.40 |
| 156 | AUS1170 | 3.98 | 1.26 | 0.32 |
| 157 | AUS1171 | 3.51 | 1.25 | 0.35 |
| 159 | AUS1174 | 0.65 | 0.93 | 1.42 |
| 160 | AUS1175 | 1.27 | 1.17 | 0.92 |
| 161 | AUS1176 | 3.05 | 1.60 | 0.52 |
| 163 | AUS1178 | 1.14 | 1.06 | 0.94 |
| 164 | AUS1179 | 1.03 | 0.64 | 0.62 |
| 165 | AUS1180 | 1.42 | 0.50 | 0.35 |
| 166 | AUS1181 | 1.48 | 0.69 | 0.46 |
| 167 | AUS1182 | 1.35 | 0.79 | 0.59 |
| 168 | AUS1183 | 2.97 | 0.60 | 0.20 |
| 169 | AUS1184 | 2.52 | 0.64 | 0.25 |
| 170 | AUS1185 | 2.52 | 0.81 | 0.32 |
| 171 | AUS1186 | 2.88 | 0.88 | 0.30 |
| 172 | AUS1187 | 1.17 | 0.65 | 0.55 |
| 173 | AUS1188 | 1.11 | 0.76 | 0.68 |
| 174 | AUS1189 | 1.51 | 0.41 | 0.27 |
| 175 | AUS1190 | 0.94 | 0.64 | 0.68 |

TABLE 14.1-continued

Antiviral effect of eASO compounds in HepG2.2.15 cells
by MMT and/or CCK8 proliferation assays

| SEQ ID NO: | ID | Ratio EC$_{50}$ | Ratio MTT CC25 or CCK8 CC30 | C/E ratio |
|---|---|---|---|---|
| 176 | AUS1191 | 1.34 | 0.91 | 0.68 |
| 177 | AUS1192 | 1.24 | 0.57 | 0.46 |
| 178 | AUS1193 | 3.30 | 0.84 | 0.26 |
| 179 | AUS1194 | 4.54 | 1.01 | 0.22 |
| 181 | AUS1198 | 2.2 | >250 | |
| 182 | AUS1199 | 6.1 | 0.3 | 0.05 |
| 183 | AUS1200 | 2.7 | >250 | |
| 184 | AUS1201 | 6.1 | 0.2 | 0.04 |
| 185 | AUS1202 | 0.7 | 0.3 | 0.44 |
| 186 | AUS1203 | 1.8 | >250 | |
| 187 | AUS1204 | 1.0 | 0.3 | 0.32 |
| 188 | AUS1205 | 4.3 | >250 | |
| 189 | AUS1206 | 2.16 | 1.71 | 0.79 |
| 190 | AUS1207 | 1.20 | 1.68 | 1.41 |
| 191 | AUS1208 | 1.29 | 2.02 | 1.56 |
| 192 | AUS1209 | 6.78 | >250 | |
| 193 | AUS1210 | 22.96 | >250 | |
| 194 | AUS1211 | >250 | >250 | |
| 195 | AUS1212 | 2.2 | 0.9 | 0.39 |
| 196 | AUS1213 | 1.6 | 0.7 | 0.41 |
| 197 | AUS1214 | 1.3 | 0.6 | 0.50 |
| 198 | AUS1215 | 1.1 | 0.4 | 0.35 |
| 199 | AUS1216 | 1.6 | 0.4 | 0.25 |
| 200 | AUS1217 | 1.8 | 0.3 | 0.16 |
| 201 | AUS1218 | 1.2 | 0.5 | 0.44 |
| 202 | AUS1219 | 0.9 | 0.3 | 0.30 |
| 203 | AUS1220 | 1.7 | 0.6 | 0.35 |
| 205 | AUS1224 | 2.7 | 1.2 | 0.46 |
| 206 | AUS1225 | 8.8 | 2.2 | 0.26 |
| 207 | AUS1226 | 19.1 | 3.0 | 0.16 |
| 208 | AUS1227 | 21.4 | 2.8 | 0.13 |
| 209 | AUS1228 | 32.4 | 4.4 | 0.14 |
| 211 | AUS1232 | | | |
| 213 | AUS1234 | 7.0 | 0.7 | 0.10 |
| 214 | AUS1235 | 3.4 | 0.6 | 0.17 |
| 215 | AUS1236 | 1.6 | 0.7 | 0.44 |
| 216 | AUS1237 | 2.4 | 0.5 | 0.21 |
| 217 | AUS1238 | 4.0 | 0.4 | 0.10 |
| 218 | AUS1241 | 0.10 | 2.08 | 20.64 |
| 219 | AUS1242 | 1.16 | 1.16 | 1.00 |
| 220 | AUS1243 | 0.79 | 1.14 | 1.44 |
| 221 | AUS1244 | 0.37 | 1.04 | 2.82 |
| 222 | AUS1245 | 1.20 | 0.97 | 0.82 |
| 223 | AUS1246 | 0.84 | 0.92 | 1.10 |
| 224 | AUS1247 | 1.18 | 0.39 | 0.33 |
| 225 | AUS1248 | 1.47 | 0.49 | 0.33 |
| 226 | AUS1249 | 0.96 | 0.75 | 0.78 |
| 227 | AUS1250 | 1.30 | 0.44 | 0.34 |
| 228 | AUS1251 | 1.23 | 0.53 | 0.43 |
| 229 | AUS1252 | 0.72 | 0.71 | 0.99 |
| 230 | AUS1253 | 0.45 | 0.59 | 1.33 |
| 231 | AUS1254 | 0.39 | 0.42 | 1.09 |
| 232 | AUS1255 | 0.50 | 0.41 | 0.83 |
| 233 | AUS1256 | 0.52 | 0.64 | 1.25 |
| 234 | AUS1257 | 0.97 | 0.93 | 0.96 |
| 235 | AUS1258 | 1.26 | 0.87 | 0.69 |
| 236 | AUS1259 | 0.76 | 0.73 | 0.95 |
| 237 | AUS1260 | 0.61 | 0.82 | 1.34 |
| 238 | AUS1261 | 1.10 | 1.11 | 1.02 |
| 239 | AUS1262 | 0.94 | 1.16 | 1.24 |
| 240 | AUS1263 | 0.50 | 1.04 | 2.09 |
| 241 | AUS1264 | 0.45 | 0.96 | 2.12 |
| 242 | AUS1266 | 2.04 | 3.37 | 1.65 |
| 243 | AUS1267 | 1.25 | 0.98 | 0.78 |
| 244 | AUS1268 | 1.81 | 1.18 | 0.65 |
| 245 | AUS1269 | 1.06 | 1.06 | 1.00 |
| 246 | AUS1270 | 1.52 | 1.31 | 0.86 |
| 247 | AUS1271 | 2.03 | 1.38 | 0.68 |
| 248 | AUS1272 | 2.78 | 1.34 | 0.48 |
| 249 | AUS1274 | 1.32 | 0.45 | 0.34 |
| 250 | AUS1275 | 0.97 | 0.34 | 0.35 |
| 251 | AUS1277 | 0.48 | 0.81 | 1.69 |
| 252 | AUS1278 | 0.29 | 1.02 | 3.48 |

TABLE 14.1-continued

Antiviral effect of eASO compounds in HepG2.2.15 cells
by MMT and/or CCK8 proliferation assays

| SEQ ID NO: | ID | Ratio EC$_{50}$ | Ratio MTT CC25 or CCK8 CC30 | C/E ratio |
|---|---|---|---|---|
| 253 | AUS1279 | 0.55 | 0.72 | 1.31 |
| 254 | AUS1280 | 0.51 | 0.67 | 1.31 |
| 255 | AUS1281 | 0.40 | 0.95 | 2.39 |
| 256 | AUS1282 | 0.29 | 0.85 | 2.92 |
| 257 | AUS1283 | 0.21 | 0.58 | 2.73 |
| 258 | AUS1284 | 0.28 | 0.92 | 3.22 |
| 259 | AUS1285 | 0.18 | 0.61 | 3.35 |
| 260 | AUS1286 | 0.38 | 0.66 | 1.75 |
| 261 | AUS1287 | 0.38 | 0.94 | 2.44 |
| 262 | AUS1288 | 0.21 | 0.98 | 4.65 |
| 263 | AUS1289 | 0.30 | 0.62 | 2.06 |
| 264 | AUS1290 | 0.25 | 0.84 | 3.41 |
| 265 | AUS1291 | 0.11 | 0.56 | 5.05 |
| 266 | AUS1292 | 0.15 | 0.58 | 3.88 |
| 267 | AUS1293 | 0.18 | 0.65 | 3.63 |
| 268 | AUS1294 | 0.12 | 0.47 | 3.74 |
| 269 | AUS1295 | 0.14 | 0.44 | 3.04 |
| 270 | AUS1296 | 0.17 | 0.58 | 3.44 |
| 271 | AUS1298 | 1.37 | 1.03 | 0.75 |
| 272 | AUS1299 | 1.88 | 1.18 | 0.62 |
| 273 | AUS1300 | 1.04 | 0.89 | 0.85 |
| 275 | AUS1302 | 1.55 | 0.88 | 0.57 |
| 276 | AUS1303 | 0.96 | 1.19 | 1.24 |
| 277 | AUS1304 | 1.02 | 1.49 | 1.46 |
| 278 | AUS1305 | 1.33 | 1.78 | 1.34 |
| 279 | AUS1306 | 1.46 | 1.12 | 0.77 |
| 280 | AUS1307 | 1.78 | 1.01 | 0.57 |
| 281 | AUS1308 | 1.23 | 1.02 | 0.83 |
| 282 | AUS1309 | 1.89 | 1.11 | 0.59 |
| 283 | AUS1310 | 1.79 | 0.98 | 0.55 |
| 284 | AUS1311 | 1.86 | 1.00 | 0.54 |
| 285 | AUS1312 | 1.34 | 1.26 | 0.94 |
| 286 | AUS1313 | 1.67 | 1.45 | 0.87 |
| 287 | AUS1314 | 2.13 | 1.18 | 0.56 |
| 288 | AUS1315 | 1.46 | 1.21 | 0.83 |
| 289 | AUS1316 | 1.91 | 1.42 | 0.74 |
| 290 | AUS1317 | 1.63 | 1.22 | 0.75 |
| 291 | AUS1318 | 1.83 | 1.19 | 0.65 |
| 292 | AUS1319 | 1.38 | 1.17 | 0.84 |
| 293 | AUS1320 | 2.08 | 1.43 | 0.69 |
| 294 | AUS1322 | 0.76 | 1.15 | 1.52 |
| 295 | AUS1323 | 0.94 | 1.32 | 1.41 |
| 296 | AUS1324 | 1.12 | 1.30 | 1.16 |
| 298 | AUS1326 | 0.14 | 0.92 | 6.60 |
| 299 | AUS1327 | 0.11 | 0.98 | 9.20 |
| 300 | AUS1328 | 0.10 | 1.00 | 9.79 |
| 301 | AUS1329 | 0.09 | 0.88 | 9.97 |
| 302 | AUS1332 | 0.12 | 3.04 | 25.45 |
| 303 | AUS1333 | 0.6 | 0.6 | 0.90 |
| 304 | AUS1334 | 0.7 | 0.6 | 0.90 |
| 305 | AUS1335 | 0.8 | 1.3 | 1.53 |
| 306 | AUS1336 | 0.8 | 1.7 | 2.05 |
| 307 | AUS1337 | 0.4 | 1.3 | 3.04 |
| 308 | AUS1338 | 0.3 | 0.8 | 2.59 |
| 309 | AUS1340 | 0.29 | 0.80 | 2.80 |
| 310 | AUS1341 | 0.26 | 0.70 | 2.64 |
| 311 | AUS1342 | 0.40 | 0.63 | 1.58 |
| 312 | AUS1343 | 0.37 | 0.85 | 2.31 |
| 313 | AUS1344 | 0.29 | 0.83 | 2.84 |
| 314 | AUS1345 | 0.24 | 0.65 | 2.63 |
| 315 | AUS1346 | 0.15 | 0.59 | 3.94 |
| 316 | AUS1347 | 0.22 | 0.44 | 2.01 |
| 317 | AUS1348 | 0.22 | 0.84 | 3.80 |
| 318 | AUS1349 | 0.14 | 0.59 | 4.34 |
| 319 | AUS1350 | 0.15 | 0.57 | 3.80 |
| 320 | AUS1351 | 0.23 | 0.66 | 2.89 |
| 321 | AUS1352 | 0.16 | 0.73 | 4.59 |
| 322 | AUS1353 | 0.15 | 0.51 | 3.48 |
| 323 | AUS1354 | 0.12 | 0.40 | 3.44 |
| 324 | AUS1355 | 0.13 | 0.60 | 4.61 |
| 325 | AUS1356 | 0.19 | 0.73 | 3.80 |
| 326 | AUS1357 | 0.14 | 0.56 | 4.02 |
| 327 | AUS1358 | 0.12 | 0.60 | 4.86 |
| 328 | AUS1359 | 0.32 | 0.71 | 2.23 |
| 329 | AUS1360 | 0.09 | 0.80 | 8.61 |
| 330 | AUS1361 | 0.13 | 0.89 | 6.85 |
| 331 | AUS1362 | 0.10 | 0.99 | 9.71 |
| 332 | AUS1365 | 0.08 | 1.94 | 24.34 |
| 333 | AUS1366 | 24.42 | >250 | |
| 334 | AUS1367 | 0.23 | 0.63 | 2.72 |
| 336 | AUS1370 | 0.74 | 1.10 | 1.49 |
| 337 | AUS1371 | 1.66 | 1.47 | 0.89 |
| 338 | AUS1372 | 0.92 | 1.44 | 1.56 |
| 339 | AUS1373 | 0.24 | 1.34 | 5.62 |
| 340 | AUS1374 | 0.74 | 1.12 | 1.51 |
| 341 | AUS1375 | 1.02 | 0.89 | 0.87 |
| 342 | AUS1376 | 0.56 | 0.93 | 1.66 |
| 343 | AUS1377 | 0.27 | 1.06 | 3.93 |
| 344 | AUS1378 | 0.48 | 0.93 | 1.93 |
| 345 | AUS1379 | 0.77 | 0.69 | 0.89 |
| 346 | AUS1382 | 0.18 | 1.06 | 5.99 |
| 347 | AUS1383 | 0.13 | 0.97 | 7.39 |
| 348 | AUS1384 | 0.15 | 1.03 | 6.86 |
| 349 | AUS1385 | 0.23 | 0.90 | 3.98 |
| 350 | AUS1387 | 1.29 | 0.82 | 0.64 |
| 351 | AUS1388 | 0.09 | 0.92 | 9.72 |
| 352 | AUS1389 | 0.13 | 0.71 | 5.31 |
| 353 | AUS1390 | 0.15 | 0.76 | 4.92 |
| 354 | AUS1391 | 0.19 | 0.76 | 3.96 |
| 355 | AUS1392 | 0.25 | 0.71 | 2.81 |
| 356 | AUS1393 | 0.27 | 0.70 | 2.59 |
| 357 | AUS1394 | 0.24 | 0.87 | 3.58 |
| 358 | AUS1395 | 0.17 | 0.97 | 5.76 |
| 359 | AUS1396 | 0.13 | 0.95 | 7.48 |
| 372 | AUS1409 | 0.04 | 1.61 | 38.05 |
| 373 | AUS1410 | 0.07 | 1.25 | 17.88 |
| 374 | AUS1411 | 0.08 | 0.83 | 10.18 |
| 375 | AUS1412 | 0.06 | 0.88 | 14.00 |
| 376 | AUS1413 | 0.07 | 0.84 | 12.46 |
| 377 | AUS1414 | 0.07 | 0.72 | 10.98 |
| 378 | AUS1415 | 0.06 | 0.75 | 13.29 |
| 385 | AUS1422 | 0.10 | 0.99 | 10.07 |
| 386 | AUS1423 | 0.07 | 0.99 | 13.47 |
| 387 | AUS1424 | 0.08 | 0.97 | 12.62 |
| 388 | AUS1425 | 0.10 | 0.95 | 9.21 |
| 389 | AUS1426 | 0.08 | 0.83 | 10.02 |
| 390 | AUS1427 | 0.07 | 0.77 | 11.07 |
| 391 | AUS1428 | 0.08 | 0.92 | 11.95 |
| 392 | AUS1429 | 0.08 | 1.22 | 15.74 |
| 393 | AUS1430 | 0.07 | 1.19 | 17.15 |
| 394 | AUS1431 | 0.05 | 1.04 | 19.01 |
| 395 | AUS1432 | 0.05 | 1.19 | 23.71 |
| 396 | AUS1433 | 0.10 | 1.09 | 10.92 |
| 397 | AUS1434 | 0.76 | 1.15 | 1.52 |
| 398 | AUS1435 | 0.18 | 1.22 | 6.70 |
| 399 | AUS1436 | 0.24 | 1.11 | 4.65 |
| 400 | AUS1437 | 0.37 | 1.33 | 3.63 |
| 401 | AUS1438 | 0.15 | 0.89 | 5.76 |
| 402 | AUS1439 | 0.34 | 1.25 | 3.72 |
| 403 | AUS1440 | 0.18 | 1.23 | 6.75 |
| 404 | AUS1441 | 0.70 | 1.31 | 1.85 |
| 406 | AUS1443 | 0.18 | 0.96 | 5.25 |
| 407 | AUS1444 | 0.22 | 0.93 | 4.17 |
| 408 | AUS1445 | 0.25 | 1.01 | 4.03 |
| 409 | AUS1446 | 0.40 | 1.46 | 3.67 |
| 410 | AUS1447 | 0.52 | 1.11 | 2.12 |
| 411 | AUS1448 | 0.67 | 1.07 | 1.59 |
| 412 | AUS1449 | 0.74 | 1.04 | 1.41 |
| 413 | AUS1450 | 0.96 | 1.26 | 1.32 |
| 414 | AUS1451 | 0.70 | 1.22 | 1.75 |
| 415 | AUS1452 | 0.54 | 1.09 | 2.00 |
| 416 | AUS1453 | 0.84 | 1.22 | 1.46 |
| 417 | AUS1454 | 0.65 | 1.00 | 1.52 |
| 418 | AUS1455 | 0.59 | 1.06 | 1.80 |
| 419 | AUS1456 | 0.56 | 1.08 | 1.91 |
| 420 | AUS1457 | 0.53 | 1.15 | 2.15 |

TABLE 14.1-continued

Antiviral effect of eASO compounds in HepG2.2.15 cells by MMT and/or CCK8 proliferation assays

| SEQ ID NO: | ID | Ratio EC$_{50}$ | Ratio MTT CC25 or CCK8 CC30 | C/E ratio |
|---|---|---|---|---|
| 421 | AUS1458 | 0.22 | 0.95 | 4.38 |
| 422 | AUS1459 | 0.25 | 1.08 | 4.33 |
| 423 | AUS1460 | 0.23 | 1.29 | 5.71 |
| 424 | AUS1461 | 0.40 | 1.75 | 4.41 |
| 425 | AUS1462 | 0.25 | 1.77 | 7.14 |
| 426 | AUS1463 | 0.27 | 1.74 | 6.37 |
| 427 | AUS1464 | 0.38 | 2.10 | 5.45 |
| 428 | AUS1465 | 0.43 | 1.32 | 3.03 |
| 429 | AUS1466 | 0.19 | 1.20 | 6.15 |
| 430 | AUS1467 | 0.24 | 1.14 | 4.72 |
| 431 | AUS1468 | 0.25 | 1.30 | 5.29 |
| 432 | AUS1469 | 0.25 | 1.22 | 4.90 |
| 433 | AUS1470 | 0.16 | 1.16 | 7.09 |
| 434 | AUS1471 | 0.18 | 1.23 | 7.03 |
| 435 | AUS1472 | 0.19 | 1.31 | 7.01 |
| 436 | AUS1473 | 0.14 | 1.37 | 9.49 |
| 437 | AUS1474 | 0.16 | 1.42 | 9.05 |
| 438 | AUS1475 | 0.18 | 1.31 | 7.39 |
| 439 | AUS1476 | 0.10 | 1.49 | 15.50 |
| 440 | AUS1477 | 0.20 | 1.28 | 6.24 |
| 441 | AUS1478 | 0.37 | 1.33 | 3.62 |
| 442 | AUS1479 | 0.13 | 1.56 | 12.00 |
| 443 | AUS1480 | 0.14 | 1.27 | 8.90 |
| 444 | AUS1481 | 0.14 | 1.05 | 7.43 |
| 445 | AUS1482 | 0.14 | 0.90 | 6.63 |
| 446 | AUS1483 | 0.14 | 1.07 | 7.62 |
| 447 | AUS1484 | 0.47 | 1.24 | 2.65 |
| 448 | AUS1485 | 0.54 | 1.24 | 2.29 |
| 449 | AUS1486 | 0.76 | 1.46 | 1.92 |
| 450 | AUS1487 | 0.68 | 1.63 | 2.39 |
| 451 | AUS1488 | 0.20 | 1.73 | 8.62 |
| 452 | AUS1489 | 0.18 | 1.81 | 10.33 |
| 453 | AUS1490 | 0.16 | 1.77 | 11.26 |
| 455 | AUS1492 | 0.25 | 1.33 | 5.32 |
| 456 | AUS1493 | 0.38 | 1.63 | 4.25 |
| 457 | AUS1494 | 0.22 | 1.47 | 6.59 |
| 458 | AUS1495 | 0.42 | 1.45 | 3.42 |
| 466 | AUS1505 | 29.7 | 0.6 | 0.02 |
| 491 | AUS1530 | >250 | >250 | |
| 492 | AUS1531 | >250 | >250 | |
| 493 | AUS1532 | >250 | >250 | |
| 494 | AUS1533 | >250 | >250 | |
| 495 | AUS1534 | >250 | >250 | |
| 496 | AUS1535 | 35.9 | >250 | |
| 497 | AUS1536 | 1.71 | >250 | |
| 498 | AUS1537 | 1.89 | >250 | |
| 499 | AUS1538 | 3.33 | >250 | |
| 500 | AUS1539 | 5.75 | >250 | |
| 501 | AUS1540 | 3.29 | >250 | |
| 502 | AUS1541 | 1.69 | >250 | |
| 503 | AUS1542 | 1.04 | >250 | |
| 504 | AUS1543 | 3.98 | >250 | |
| 505 | AUS1544 | >250 | >250 | |
| 506 | AUS1545 | 35.96 | >250 | |
| 507 | AUS1546 | 1.65 | 0.76 | 0.46 |
| 508 | AUS1547 | >250 | >250 | |
| 509 | AUS1548 | >250 | >250 | |
| 510 | AUS1549 | >250 | >250 | |
| 511 | AUS1550 | >250 | >250 | |
| 512 | AUS1551 | 9.57 | >250 | |
| 513 | AUS1552 | 6.70 | >250 | |
| 539 | AUS1578 | 2.9 | 1.8 | 0.62 |
| 540 | AUS1579 | 2.0 | 0.5 | 0.24 |
| 541 | AUS1580 | 6.9 | 1.1 | 0.16 |
| 542 | AUS1581 | 3.2 | 0.4 | 0.11 |
| 543 | AUS1582 | 2.00 | 2.82 | 1.41 |
| 544 | AUS1583 | 2.16 | 0.82 | 0.38 |
| 545 | AUS1584 | 1.08 | 0.80 | 0.74 |
| 546 | AUS1585 | 1.19 | 0.82 | 0.69 |
| 547 | AUS1586 | 0.49 | 0.91 | 1.88 |
| 548 | AUS1587 | 0.94 | 1.78 | 1.90 |
| 549 | AUS1588 | 4.31 | 1.07 | 0.25 |
| 550 | AUS1589 | 0.99 | 1.41 | 1.42 |
| 551 | AUS1590 | 2.86 | 3.82 | 1.33 |
| 552 | AUS1591 | >250 | 5.82 | |
| 553 | AUS1592 | 5.7 | 3.1 | 0.53 |
| 554 | AUS1593 | 4.0 | 2.6 | 0.67 |
| 555 | AUS1594 | 2.6 | 1.8 | 0.68 |
| 556 | AUS1595 | 2.7 | 1.2 | 0.45 |
| 557 | AUS1596 | 2.8 | 3.5 | 1.25 |
| 558 | AUS1597 | 1.3 | 1.6 | 1.21 |
| 559 | AUS1598 | 1.9 | 1.5 | 0.77 |
| 560 | AUS1599 | 1.6 | 0.4 | 0.27 |
| 561 | AUS1600 | 1.8 | 0.8 | 0.46 |
| 562 | AUS1601 | 7.5 | 8.9 | 1.18 |
| 563 | AUS1602 | 1.2 | 0.6 | 0.55 |
| 564 | AUS1603 | 0.9 | 0.9 | 0.99 |
| 565 | AUS1604 | 1.3 | 1.1 | 0.85 |
| 566 | AUS1605 | 1.7 | 7.4 | 4.40 |
| 567 | AUS1606 | 1.1 | 1.2 | 1.04 |
| 568 | AUS1607 | 1.8 | 1.8 | 1.00 |
| 569 | AUS1608 | 2.1 | 3.0 | 1.44 |
| 570 | AUS1609 | 1.0 | 0.8 | 0.78 |
| 571 | AUS1610 | 1.5 | 1.1 | 0.75 |
| 572 | AUS1611 | 1.4 | 1.2 | 0.86 |
| 573 | AUS1612 | 1.0 | 0.5 | 0.51 |
| 574 | AUS1613 | 1.2 | 0.7 | 0.56 |
| 575 | AUS1614 | 2.9 | 1.3 | 0.46 |
| 576 | AUS1615 | 2.4 | 2.3 | 0.96 |
| 577 | AUS1616 | 1.4 | 2.6 | 1.88 |
| 578 | AUS1617 | 1.3 | 1.8 | 1.32 |
| 579 | AUS1618 | 2.3 | 0.8 | 0.37 |
| 580 | AUS1619 | 5.9 | 4.3 | 0.72 |
| 581 | AUS1620 | 6.7 | >250 | |
| 582 | AUS1621 | 11.7 | 0.8 | 0.07 |
| 583 | AUS1622 | 17.6 | 4.1 | 0.23 |
| 584 | AUS1623 | 11.9 | >250 | |
| 585 | AUS1624 | 1.5 | >250 | |
| 586 | AUS1625 | 1.1 | >250 | |
| 587 | AUS1626 | 4.2 | >250 | |
| 588 | AUS1627 | 7.1 | 2.4 | 0.33 |
| 589 | AUS1628 | 11.4 | 2.7 | 0.24 |
| 590 | AUS1629 | 20.8 | 3.9 | 0.19 |
| 591 | AUS1630 | 2.4 | >250 | |
| 614 | AUS1653 | 0.45 | | 0.00 |
| 615 | AUS1654 | 0.67 | | 0.00 |
| 616 | AUS1655 | 0.43 | | 0.00 |
| 617 | AUS1656 | 1.14 | 0.29 | 0.26 |
| 618 | AUS1657 | 0.44 | | 0.00 |
| 619 | AUS1658 | 0.78 | | 0.00 |
| 620 | AUS1659 | 0.87 | | 0.00 |
| 621 | AUS1660 | 0.63 | | 0.00 |
| 624 | AUS1663 | | | |
| 627 | AUS1666 | | | |
| 631 | AUS1670 | 1.12 | 3.19 | 2.84 |
| 639 | AUS1679 | 1.4 | >250 | |
| 641 | AUS1683 | 1.23 | 0.78 | 0.63 |
| 642 | AUS1684 | 2.74 | 2.19 | 0.80 |
| 643 | AUS1685 | 2.66 | 0.98 | 0.37 |
| 659 | AUS1705 | 5.7 | 0.3 | |
| 660 | AUS1708 | 43.0 | >250 | |
| 661 | AUS1709 | 41.4 | >250 | |
| 662 | AUS1710 | 5.95 | 0.17 | 0.03 |
| 664 | AUS1712 | | | |
| 665 | AUS1713 | 5.6 | 3.0 | 0.54 |
| 666 | AUS1714 | 8.5 | 3.7 | 0.43 |

Example 15: Antiviral Effect of Modified Oligonucleotide Compounds in Genotype C 1.0 HBV Transgenic Mice To evaluate the effect of modified oligonucleotide compounds on the serum levels of HBsAg in genotype C 1.0 HBV (HBV-GTC) transgenic mice, each compound was dosed once at 10, 30, or 40 mg/kg by subcutaneous injection (SC) to the mice and injection volume was 10 ml/kg. Normal saline was administered as negative control. The HBsAg levels was measured in the serum samples by Chemiluminescence immunoassay assays. The resulting data was expressed as mean and SD.

HBV transgenic mice, prepared from male C57BL/6 mice of 5-7 weeks old with 1.0-fold length of HBV C1 subtype genome, stably express HBsAg in liver. The methods and purposes of animal experiments are in accordance with the ethical standards and international practices.

The modified oligonucleotide dosing solutions were prepared by dissolving each compound in saline to make a stock solution at 10 mg/ml, which was diluted with saline again at a target concentration.

The male HBV transgenic mice were randomly divided into every group according to serum HBsAg level. Each group was dosed with one compound by subcutaneous injection at a target concentration and a dose volume of 10 ml/kg of body weight or an equal volume of normal saline as control.

Approximately 80 μl of blood sample was taken from a thigh vein on Day 0 (before dosing), 3, 7, 10, 14, 21 and/or 28 after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further HBsAg analysis.

Tables 15.1-15.7. (FIGS. 14-20) show the results of this experiment. Table 15.1 (FIG. 14) shows that a reduction in serum levels of HBsAg, relative to the reference compound AUS1233 was observed on Day 28 following treatment with a single 40 mg/kg subcutaneous dose of AUS1684, AUS1322, AUS1323 or AUS1324 on Day 0, suggesting a persistent and enhanced modified oligonucleotide antiviral activity relative to AUS1233. n=5 mice were tested for each group.

Table 15.2 (FIG. 15) shows that a reduction in serum levels of HBsAg, relative to the reference compound AUS1233 was observed on Day 28 following treatment with a single 40 mg/kg subcutaneous dose of AUS1169, AUS1171, AUS1170, AUS1168, or AUS1322 on Day 0, suggesting a persistent and enhanced modified oligonucleotide antiviral activity relative to AUS1233. n=4 mice were tested in each group.

Table 15.3 (FIG. 16) shows that a reduction in serum levels of HBsAg, relative to the reference compound AUS1233 was observed on Day 21 following treatment with a single 30 mg/kg subcutaneous dose of AUS1434, AUS1435, AUS1440, AUS1436, AUS1437, AUS1438, AUS1439, AUS1422, AUS1424, AUS1425, AUS1427, AUS1428, AUS1430, AUS1431, or AUS1432 on Day 0, suggesting a persistent and enhanced modified oligonucleotide antiviral activity relative to AUS1233. n=2 or 3 mice were tested in each group.

Table 15.4 (FIG. 17) shows that a reduction in serum levels of HBsAg, relative to the reference compound AUS1233 was observed on Day 21 following treatment with a single 30 mg/kg subcutaneous dose of AUS1463, AUS1466, AUS1476, AUS1472, AUS1489, or AUS1459 on Day 0, suggesting a persistent and enhanced modified oligonucleotide antiviral activity relative to AUS1233. n=4 mice were tested in each group.

Table 15.5 (FIG. 18) shows that a reduction in serum levels of HBsAg, relative to the reference compound AUS1233 was observed on Day 28 following treatment with a single 30 mg/kg subcutaneous dose of AUS1492, AUS1495, AUS1494, or AUS1493 on Day 0, suggesting a persistent and enhanced modified oligonucleotide antiviral activity relative to AUS1233. n=4 mice were tested in each group.

Table 15.6 (FIG. 19) shows >1.4 fold reduction in serum levels of HBsAg, relative to the reference compound AUS1233 was observed on Day 21 following treatment with a single 40 mg/kg subcutaneous dose of AUS1695 on Day 0, suggesting a persistent and enhanced modified oligonucleotide antiviral activity relative to AUS1233. n=1 or 2 mice were tested in each group.

Rows 1 and 2 of Table 15.7 (FIG. 20) shows a reduction in serum levels of HBsAg on Day 28 following treatment with a single 10 mg/kg subcutaneous dose of AUS1493 on Day 0 relative to treatment with a single 10 mg/kg subcutaneous dose of AUS1233 on Day 0, suggesting a persistent and enhanced modified oligonucleotide antiviral activity relative to AUS1233. Rows 3 and 4 of Table 15.7 (FIG. 20) shows a reduction in serum levels of HBsAg on Day 28 following treatment with a single 30 mg/kg subcutaneous dose of AUS1493 on Day 0 relative to treatment with a single 30 mg/kg subcutaneous dose of AUS1233 on Day 0, suggesting a persistent and enhanced modified oligonucleotide antiviral activity relative to AUS1233.

Example 16: Antiviral Effect of Modified Oligonucleotide Compounds in HDI-HBV Carrier Mice To evaluate the effect of modified oligonucleotide compounds on the serum levels of HBsAg in genotype A, B, C and D (GT-A/B/C/D) hydrodynamic-injection HBV (HDI-HBV) mice, each compound was dosed once at target dosage by subcutaneous injection (SC) to the mice and injection volume was 10 ml/kg. Normal saline was administered as negative control. The HBsAg levels were measured in the serum samples by Chemiluminescence immunoassay assays. The resulting data was expressed as mean and SD.

The HDI-HBV mouse model was constructed in male C57BL/6 mice of 5-7 weeks old by hydrodynamic-injection a target concentration GT-A/B/C/D pcDNA3.1-preS2/S plasmid (or pAAV-1.2HBV plasmid) solution containing HBV sequence, HBsAg-positive mice were used 2 to 3-week after the injection. The methods and purposes of animal experiments are in accordance with the ethical standards and international practices.

The modified oligonucleotide dosing solutions were prepared by dissolving each compound in saline to make a stock solution at 10 mg/ml, which was diluted with saline again at a target concentration.

The male GT-A/B/CD HDI-HBV mice were randomly divided into every group according to serum HBsAg level. Each group was dosed with one compound by subcutaneous injection at a target concentration and a dose volume of 10 ml/kg of body weight or an equal volume of normal saline as control.

Approximately 80 μl of blood sample was taken from a thigh vein on Day 0 (before dosing), 3, 7, 10, 14, 21, 22, and/or 28 after dosing. Blood samples were placed in an incubator at 37° C. for approximately 30 minutes, and then centrifuged in a precooled (0-4° C.) centrifuge to obtain the serum samples. The obtained serum samples were stored in a −20° C. refrigerator for further HBsAg analysis.

Tables 16.1-16.18. (FIG. 21-38) show the results of this experiment. Table 4.1 (FIG. 21) shows that a reduction in serum levels of HBsAg in GT-D HDI HBV mice, relative to the reference compound AUS1233 was observed on Day 28 following treatment with a single 60 mg/kg subcutaneous dose of AUS1684, AUS1322, AUS1323 or AUS1324 on Day 0, suggesting a persistent and enhanced modified oligonucleotide antiviral activity relative to AUS1233.

Table 16.2 (FIG. 22) shows the resulting serum levels of HBsAg in GT-D HDI HBV mice following a single 40 mg/kg subcutaneous dose of AUS1169, AUS1171, AUS1170, or AUS1168 on Day 0, suggesting a persistent and enhanced modified oligonucleotide antiviral activity relative to AUS1233.

Table 16.3 (FIG. 23) shows that a reduction in serum levels of HBsAg in GT-D HDI HBV mice, relative to the reference compound AUS1233 was observed on Day 21 following treatment with a single 60 mg/kg subcutaneous dose of AUS1173 or AUS1174 on Day 0, suggesting a persistent and enhanced modified oligonucleotide antiviral activity relative to AUS1233.

Table 16.4 (FIG. 24) shows that a reduction in serum levels of HBsAg in GT-D HDI HBV mice, relative to the reference compound AUS1233 was observed on Day 14 following treatment with a single 60 mg/kg subcutaneous dose of AUS1173, AUS1178, AUS1185, AUS1186, AUS1188, AUS1190, AUS1192, AUS1193, AUS1183, AUS1325, AUS1326, AUS1327, AUS1328, AUS1329, AUS1175, AUS1361, or AUS1362 on Day 0, suggesting a persistent and enhanced modified oligonucleotide antiviral activity relative to AUS1233.

Table 16.5 (FIG. 25) shows that a reduction in serum levels of HBsAg in GT-D HDI HBV mice, relative to the reference compound AUS1233 was observed on Day 22 following treatment with a single 60 mg/kg subcutaneous dose of AUS1322, AUS1382, AUS1383, AUS1384, or AUS1385 on Day 0, suggesting a persistent and enhanced modified oligonucleotide antiviral activity relative to AUS1233.

Table 16.6 (FIG. 26) shows the resulting serum levels of HBsAg in GT-D HDI HBV mice following a single 60 mg/kg subcutaneous dose of AUS1322, AUS1388, AUS1389, AUS1390, AUS1392, AUS1393, AUS1396, AUS1403, AUS1409, AUS1411, AUS1413, AUS1414, or AUS1415 on Day 0.

Table 16.7 (FIG. 27) shows the resulting serum levels of HBsAg in GT-D HDI HBV mice following a single 60 mg/kg subcutaneous dose of AUS1387, AUS1326, AUS1328, AUS1388, AUS1390, AUS1403, or AUS1360 on Day 0.

Table 16.8 (FIG. 28) shows that a reduction in serum levels of HBsAg in GT-D HDI HBV mice, relative to the reference compound AUS1233 was observed on Day 21 following treatment with a single 40 mg/kg subcutaneous dose of AUS1434, AUS1435, AUS1440, AUS1436, AUS1437, AUS1438, AUS1439, AUS1441, AUS1422, AUS1423, AUS1424, AUS1425, AUS1426, AUS1427, AUS1428, AUS1429, AUS1430, AUS1431, AUS1432, or AUS1433 on Day 0, suggesting a persistent and enhanced modified oligonucleotide antiviral activity relative to AUS1233.

Table 16.9 (FIG. 29) shows that a reduction in serum levels of HBsAg in GT-D HDI HBV mice, relative to the reference compound AUS1233 was observed on Day 21 following treatment with a single 40 mg/kg subcutaneous dose of AUS1444, AUS1458, AUS1459, AUS1460, AUS1461, AUS1462, AUS1463, AUS1464, AUS1465, AUS1466, AUS1467, AUS1468, AUS1469, AUS1470, AUS1471, AUS1472, AUS1473, AUS1474, AUS1476, AUS1477, AUS1478, AUS1479, AUS1480, AUS1481, AUS1482, AUS1488, AUS1489, AUS1490, AUS1443, AUS1444, or AUS1445 on Day 0, suggesting a persistent and enhanced modified oligonucleotide antiviral activity relative to AUS1233.

Table 16.10 (FIG. 30) shows that a reduction in serum levels of HBsAg in GT-D HDI HBV mice, relative to the reference compound AUS1233 was observed on Day 28 following treatment with a single 15 mg/kg subcutaneous dose of AUS1492 or AUS1493 on Day 0, suggesting a persistent and enhanced modified oligonucleotide antiviral activity relative to AUS1233.

Rows 1, 2 and 3 of Table 4.11 (FIG. 31) shows a reduction in serum levels of HBsAg in GT-A HDI HBV mice, observed on Day 28 following treatment with a single 15 mg/kg subcutaneous dose of AUS1492 or AUS1493 on Day 0, relative to a single 15 mg/kg subcutaneous dose of AUS1233 on Day 0, suggesting a persistent and enhanced modified oligonucleotide antiviral activity relative to AUS1233.

Rows 3, 4 and 5 of Table 4.11 (FIG. 31) shows a reduction in serum levels of HBsAg in GT-A HDI HBV mice, observed on Day 28 following treatment with a single 45 mg/kg subcutaneous dose of AUS1492 or AUS1493 on Day 0, relative to a single 45 mg/kg subcutaneous dose of AUS1233 on Day 0, suggesting a persistent and enhanced modified oligonucleotide antiviral activity relative to AUS1233.

Table 4.12 (FIG. 32) shows the resulting serum levels of HBsAg in GT-A HDI HBV mice following a single 15 or 45 mg/kg subcutaneous dose of AUS1441, AUS1466, AUS1472, AUS1488, or AUS1489 on Day 0.

Table 4.13 (FIG. 33) shows the resulting serum levels of HBsAg in GT-D HDI HBV mice following a single 15 or 45 mg/kg subcutaneous dose of AUS1495, AUS1494, AUS1492, or AUS1441 on Day 0.

Table 4.14 (FIG. 34) shows the resulting serum levels of HBsAg in GT-A HDI HBV mice following a single 15 or 45 mg/kg subcutaneous dose of AUS1495, AUS1494, AUS1492, AUS1482, or AUS1441 on Day 0.

Table 4.15 (FIG. 35) shows that a reduction in serum levels of HBsAg in GT-B HDI HBV mice, relative to the reference compound AUS1233 was observed on Day 21 following treatment with a single 40 mg/kg subcutaneous dose of AUS1684 on Day 0, suggesting a persistent and enhanced modified oligonucleotide antiviral activity relative to AUS1233.

Table 4.16 (FIG. 36) shows that a reduction in serum levels of HBsAg in GT-A 1.2HBV transgenic mice, relative to the reference compound AUS1233 was observed on Day 28 following treatment with a single 45 mg/kg subcutaneous dose of AUS1492 or AUS1493 on Day 0, suggesting a persistent and enhanced modified oligonucleotide antiviral activity relative to AUS1233.

Table 4.17 (FIG. 37) shows that a reduction in serum levels of HBsAg in GT-A HDI HBV mice, relative to the reference compound AUS1233 was observed on Day 21 following treatment with a single 40 mg/kg subcutaneous dose of AUS1396, AUS1422, AUS1423, AUS1424, AUS1426, AUS1427, AUS1428, AUS1429, AUS1430, AUS1431, AUS1432, or AUS1433 on Day 0, suggesting a persistent and enhanced modified oligonucleotide antiviral activity relative to AUS1233.

Table 4.18 (FIG. 38) shows that a reduction in serum levels of HBsAg in GT-A HDI HBV mice, relative to the reference compound AUS1233 was observed on Day 21 following treatment with a single 40 mg/kg subcutaneous dose of AUS1444, AUS1458, AUS1459, AUS1460, AUS1461, AUS1462, AUS1463, AUS1464, AUS1465, AUS1466, AUS1467, AUS1468, AUS1470, AUS1471, AUS1472, AUS1473, AUS1475, AUS1476, AUS1478, AUS1479, AUS1480, AUS1481, AUS1483, AUS1489, AUS1490, AUS1443, or AUS1434 on Day 0, suggesting a persistent and enhanced modified oligonucleotide antiviral activity relative to AUS1233.

Example 17: Antiviral Effect of eASO Compounds in AAV-HBV Carrier Mice

To evaluate effect of eASO compounds on the serum levels of HBsAg in adeno-associated virus-hepatitis B virus (AAV-HBV) transfected mice, each compound was dosed once at target dosage by subcutaneous injection (SC) to the mice and injection volume was 10 ml/kg. Normal saline was administered as negative control.

The male C57BL/6 mice were aged 4-5 weeks and prepared, all the mice were injected through tail vein with $1 \times 10^{11}$ vector genome of AAV-HBV in 200 μL phosphate buffered saline per mouse on predose Day 0. Animal clinical signs were monitored twice daily during model development phase, and body weight was measured on predose Days 0, 21, and 28. Serum samples of per mouse prepared on Predose Day 21, 28 were transferred to the quantitative detections of HBsAg, HBeAg, and HBV DNA levels, HBsAg-positive mice were used 4 to 5 week after the injection. The methods and purposes of these animal experiments are in accordance with the ethical standards and international practices.

The eASO dosing solutions were prepared by dissolving each compound in saline to make a stock solution at 10 mg/ml, which was diluted with saline again at a target concentration.

Based on animal body weight and serum HBsAg, HBeAg, HBV DNA levels on predose Day 28, all transfected mice were randomized into each group. Each group was dosed with one compound by subcutaneous injection at a target concentration and a dose volume of 10 ml/kg of body weight or an equal volume of normal saline as control.

Approximately 80 μl of blood sample was taken from a thigh vein on Day 0 (before dosing), 3, 7, 10, 14, 21 and 28 after dosing. Blood samples were placed in an incubator at 37° C. for approximately 30 minutes, and then centrifuged in a precooled (0-4° C.) centrifuge to obtain the serum samples. The obtained serum samples were stored in a –20° C. refrigerator for further HBsAg, HBeAg, HBV DNA analysis. Serum HBsAg and HBeAg levels were detected using ARCHITECT i2000 (Abbott Laboratories, Lake Bluff, IL, USA) with supporting reagents. Serum HBV DNA levels were analyzed by QuantStudio™ 3 System (Applied Biosystems, Foster City, CA, USA) with detection kit (Sansure Biotech Inc., Changsha, Hunan, China).

Table 17 (FIG. 39) show the results of this experiment, a reduction in serum levels of HBsAg/HBeAg/HBV DNA in GT-D AAV HBV mice, relative to the reference compound AUS1233 was observed on Day 28 following treatment with a single 40 mg/kg subcutaneous dose of AUS1493 on Day 0, suggesting a persistent and enhanced eASO antiviral activity relative to AUS1233.

Example 18: Toxicity Evaluation of eASO Compounds in Male C57BL/6 Mice

To evaluate effect of eASO compounds on the serum levels of alanine aminotransferase (ALT) and aspartate aminotransferase (AST) in male C57BL/6 mice, each compound was dosed triple at target dosage by subcutaneous injection (SC) on Day 0, 2, 4 and injection volume was 10 ml/kg. Normal saline was administered as negative control.

The male C57BL/6 mice were age d 6-7 weeks and prepared. The eASO dosing solutions were prepared by dissolving each compound in saline to make a stock solution at 20 mg/ml, which was diluted with saline again at a target concentration.

Based on animal body weight, all mice were randomized into each group. Each group was dosed with one compound by subcutaneous injection at a target concentration and a dose volume of 10 ml/kg of body weight or an equal volume of normal saline as control.

Approximately 80 μl of blood sample was taken from a thigh vein on Day 7, 10, 14, 21 and 28 after dosing. Blood samples were placed in an incubator at 37° C. for approximately 30 minutes, and then centrifuged in a precooled (0-4° C.) centrifuge to obtain the serum samples. The obtained serum samples were stored in a –20° C. refrigerator for further ALT and analysis. Serum ALT and AST levels were detected using colorimetric analysis kts.

Tables 18.1-18.2 (FIG. 40-41) show the results of this experiment. The tables shows that a reduction in serum levels of ALT in WT male C57BL/6 mice, relative to the reference compound AUS1233 when the mice were dosed on Day 0, 2 and 4 at 60 mg/kg by SC (n=3 mice for every group). A reduction of serum ALT levels were observed on Day 21 following treatment with AUS1434, AUS1435, AUS1440, AUS1436, AUS1437, AUS1438, AUS1439, AUS1441, AUS1178, AUS1190, AUS1188, AUS1192, AUS1422, AUS1423, AUS1424, AUS1425, AUS1426, AUS1427, AUS1428, AUS1429, AUS1430, AUS1431, AUS1432, AUS1433, AUS1360, AUS1401, AUS1361, AUS1362, AUS1443, AUS1444, AUS1445, AUS1446, AUS1447, AUS1448, AUS1449, AUS1450, AUS1452, AUS1453, AUS1454, AUS1455, AUS1456, or AUS1457, suggesting a reduced eASO toxicity relative to AUS1233 over time. These results show that the modified oligonucleotides can result in a 1.2 fold to 7.7 fold reduction in serum ALT levels on Day 21, suggesting reduced toxicity.

SEQUENCE LISTING (838 sequences)

SEQ ID NO: 1 - DNA, 19 bp, Hepatitis B virus
  source 1..19: mol_type = genomic DNA
cttggtcatgggccatcag

SEQ ID NO: 2 - DNA, 20 bp, synthetic construct
  source 1..20: mol_type = other DNA
gcagaggtgaagcgaagtgc

SEQ ID NO: 3 - DNA, 3182 bp, Hepatitis B virus
  source 1..3182: mol_type = genomic DNA
aattccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtgg

SEQ ID NO: 4 - DNA, 20 bp, Hepatitis B virus
  source 1..20: mol_type = genomic DNA
gcacttcgcttcacctctgc

SEQ ID NO: 5 - DNA, 20 bp, synthetic construct
  source 1..20: mol_type = other DNA
gtgaagcgaagtgcacacgg

SEQ ID NO: 6-9 - skipped (4 entries)

SEQ ID NO: 10 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 11 - DNA, 40 bp, synthetic construct
  source 1..40: mol_type = other DNA
  modified_base 1: mod_base = OTHER; note = 2'-deoxy cytidine
  modified_base 5: mod_base = OTHER; note = 2'-deoxy cytidine
  modified_base 8: mod_base = OTHER; note = 2'-deoxy cytidine
  modified_base 12: mod_base = OTHER; note = 2'-deoxy cytidine
  modified_base 23: mod_base = OTHER; note = 2'-deoxy cytidine
  modified_base 30: mod_base = OTHER; note = 2'-deoxy cytidine
  modified_base 31: mod_base = OTHER; note = 2'-deoxy cytidine
  modified_base 34: mod_base = OTHER; note = 2'-deoxy cytidine
  modified_base 37: mod_base = OTHER; note = 2'-deoxy cytidine
caaacaacaagcagaggtgaagcgaagtgccaacaacaaa

SEQ ID NO: 12 - DNA, 40 bp, synthetic construct
  source 1..40: mol_type = other DNA
  modified_base 2: mod_base = OTHER; note = 2'-deoxy 5-methylcytidine
  modified_base 13: mod_base = OTHER; note = 2'-deoxy 5-methylcytidine
  modified_base 20: mod_base = OTHER; note = 2'-deoxy 5-methylcytidine
  modified_base 24: mod_base = OTHER; note = 2'-deoxy 5-methylcytidine
  modified_base 27: mod_base = OTHER; note = 2'-deoxy 5-methylcytidine
  modified_base 31: mod_base = OTHER; note = 2'-deoxy 5-methylcytidine
  modified_base 34: mod_base = OTHER; note = 2'-deoxy 5-methylcytidine
  modified_base 38: mod_base = OTHER; note = 2'-deoxy 5-methylcytidine
gcagaggtgaagcgaagtgcaaacaacaaacaacaaacaa

SEQ ID NO: 13 - RNA, 20 nt, synthetic construct
  source 1..20: mol_type = other RNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl guanosine
  modified_base 10: mod_base = OTHER; note = 2'-O-methoxyethyl adenosine
  modified_base 11: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-O-methoxyethyl 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
gcagaggtgaagcgaagtgc

SEQ ID NO: 14 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl guanosine
  modified_base 12: mod_base = OTHER; note = 2'-O-methoxyethyl guanosine
  modified_base 13: mod_base = OTHER; note = 2'-O-methoxyethyl 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..9: note = RNA
  misc_feature 10..11: note = DNA
  misc_feature 12..20: note = RNA
gcagaggtgaagcgaagtgc

SEQ ID NO: 15 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 13: mod_base = OTHER; note = 2'-O-methoxyethyl 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..8: note = RNA
  misc_feature 9..12: note = DNA
  misc_feature 13..20: note = RNA
gcagaggtgaagcgaagtgc

SEQ ID NO: 16 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..14: note = DNA
  misc_feature 15..20: note = RNA
gcagaggtgaagcgaagtgc

SEQ ID NO: 17 - DNA, 40 bp, synthetic construct; identical to SEQ ID NO: 11
  source 1..40: mol_type = other DNA
  modified_base 1: mod_base = OTHER; note = 2'-O-methyl 5-methylcytidine
  modified_base 2: mod_base = OTHER; note = 2'-O-methyl adenosine
  modified_base 3: mod_base = OTHER; note = 2'-O-methyl adenosine
  modified_base 4: mod_base = OTHER; note = 2'-O-methyl adenosine
  modified_base 5: mod_base = OTHER; note = 2'-O-methyl 5-methylcytidine
  modified_base 6: mod_base = OTHER; note = 2'-O-methyl adenosine
  modified_base 7: mod_base = OTHER; note = 2'-O-methyl adenosine
  modified_base 8: mod_base = OTHER; note = 2'-O-methyl 5-methylcytidine
  modified_base 9: mod_base = OTHER; note = 2'-O-methyl adenosine
  modified_base 10: mod_base = OTHER; note = 2'-O-methyl adenosine
  modified_base 11: mod_base = OTHER; note = 2'-O-methyl guanosine
  modified_base 12: mod_base = OTHER; note = 2'-O-methyl 5-methylcytidine
  modified_base 13: mod_base = OTHER; note = 2'-O-methyl adenosine
  modified_base 14: mod_base = OTHER; note = 2'-O-methyl guanosine
  modified_base 15: mod_base = OTHER; note = 2'-O-methyl adenosine
  modified_base 23: mod_base = OTHER; note = 2'-deoxy cytidine
  modified_base 26: mod_base = OTHER; note = 2'-O-methyl adenosine
  modified_base 27: mod_base = OTHER; note = 2'-O-methyl guanosine
  modified_base 28: mod_base = OTHER; note = 2'-O-methyl thymidine
  modified_base 29: mod_base = OTHER; note = 2'-O-methyl guanosine
  modified_base 30: mod_base = OTHER; note = 2'-O-methyl 5-methylcytidine
  modified_base 31: mod_base = OTHER; note = 2'-O-methyl 5-methylcytidine
  modified_base 32: mod_base = OTHER; note = 2'-O-methyl adenosine
  modified_base 33: mod_base = OTHER; note = 2'-O-methyl adenosine
  modified_base 34: mod_base = OTHER; note = 2'-O-methyl 5-methylcytidine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl 5-methylcytidine
  modified_base 38: mod_base = OTHER; note = 2'-O-methyl adenosine
  modified_base 39: mod_base = OTHER; note = 2'-O-methyl adenosine
  modified_base 40: mod_base = OTHER; note = 2'-O-methyl adenosine
  misc_feature 1..15: note = RNA
  misc_feature 16..25: note = DNA
  misc_feature 26..40: note = RNA

SEQ ID NO: 18 - RNA, 20 nt, synthetic construct
  source 1..20: mol_type = other RNA
  modified_base 1: mod_base = OTHER; note = 2'-O-methyl guanosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl guanosine
  modified_base 5: mod_base = OTHER; note = 2'-O-methyl adenosine
  modified_base 6: mod_base = OTHER; note = 2'-O-methyl guanosine
  modified_base 7: mod_base = OTHER; note = 2'-O-methyl guanosine
  modified_base 8: mod_base = OTHER; note = 2'-O-methyl thymidine
  modified_base 9: mod_base = OTHER; note = 2'-O-methyl guanosine
  modified_base 10: mod_base = OTHER; note = 2'-O-methyl adenosine
  modified_base 11: mod_base = OTHER; note = 2'-O-methyl adenosine
  modified_base 12: mod_base = OTHER; note = 2'-O-methyl guanosine
  modified_base 13: mod_base = OTHER; note = 2'-O-methyl 5-methylcytidine
  modified_base 14: mod_base = OTHER; note = 2'-O-methyl guanosine
  modified_base 15: mod_base = OTHER; note = 2'-O-methyl adenosine
  modified_base 16: mod_base = OTHER; note = 2'-O-methyl adenosine
  modified_base 17: mod_base = OTHER; note = 2'-O-methyl guanosine
  modified_base 18: mod_base = OTHER; note = 2'-O-methyl thymidine
  modified_base 19: mod_base = OTHER; note = 2'-O-methyl guanosine
  modified_base 20: mod_base = OTHER; note = 2'-O-methyl 5-methylcytidine
gcagaggtgaagcgaagtgc

SEQ ID NO: 19 - RNA, 20 nt, synthetic construct
  source 1..20: mol_type = other RNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl guanosine
  modified_base 10: mod_base = OTHER; note = 2'-O-methoxyethyl adenosine
  modified_base 11: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-O-methoxyethyl 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
gcagaggtgaagcgaagtgc

SEQ ID NO: 20 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..10: note = RNA
  misc_feature 11..14: note = DNA
  misc_feature 15..20: note = RNA
gcagaggtgaagcgaagtgc

SEQ ID NO: 21 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl guanosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..9: note = RNA
  misc_feature 10..14: note = DNA
  misc_feature 15..20: note = RNA
gcagaggtgaagcgaagtgc

SEQ ID NO: 22 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..8: note = RNA
  misc_feature 9..14: note = DNA
  misc_feature 15..20: note = RNA
gcagaggtgaagcgaagtgc

SEQ ID NO: 23 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 13: mod_base = OTHER; note = 2'-deoxy 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..7: note = RNA
  misc_feature 8..13: note = DNA
  misc_feature 14..20: note = RNA
gcagaggtgaagcgaagtgc

SEQ ID NO: 24 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..7: note = RNA
  misc_feature 8..14: note = DNA
  misc_feature 15..20: note = RNA
gcagaggtgaagcgaagtgc

SEQ ID NO: 25 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..14: note = DNA
  misc_feature 15..20: note = RNA
gcagaggtgaagcgaagtgc

SEQ ID NO: 26 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..9: note = DNA
  misc_feature 10: note = RNA
  misc_feature 11..14: note = DNA
  misc_feature 15..20: note = RNA
gcagaggtgaagcgaagtgc

SEQ ID NO: 27 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..8: note = RNA
  misc_feature 9..14: note = DNA
  misc_feature 15..20: note = RNA
gcagaggtgaagcgaagtgc

SEQ ID NO: 28 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..14: note = DNA
  misc_feature 15..20: note = RNA
gcagaggtgaagcgaagtgc

SEQ ID NO: 29 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..9: note = DNA
  misc_feature 10: note = RNA
  misc_feature 11..14: note = DNA
  misc_feature 15..20: note = RNA
gcagaggtgaagcgaagtgc

SEQ ID NO: 30 - DNA, 19 bp, synthetic construct
  source 1..19: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  misc_feature 1: note = RNA
  misc_feature 2: note = DNA
  misc_feature 3..6: note = RNA
  misc_feature 7..14: note = DNA
  misc_feature 15..19: note = RNA
gcagaggtgaagcgaagtg

SEQ ID NO: 31 - DNA, 18 bp, synthetic construct
  source 1..18: mol_type = other DNA
  modified_base 1: mod_base = OTHER; note = 2'-deoxy 5-methylcytidine
  modified_base 2: mod_base = OTHER; note = Locked nucleic acid with adenine base
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl guanosine
  modified_base 12: mod_base = OTHER; note = 2'-deoxy 5-methylcytidine
  modified_base 14: mod_base = OTHER; note = 2'-O-methoxyethyl adenosine
  modified_base 15: mod_base = OTHER; note = Locked nucleic acid with adenine base
  modified_base 16: mod_base = OTHER; note = Locked nucleic acid with guanine base
  modified_base 17: mod_base = OTHER; note = 2'-O-methoxyethyl thymidine
  modified_base 18: mod_base = OTHER; note = 2'-O-methoxyethyl guanosine
  misc_feature 1: note = DNA
  misc_feature 2..5: note = RNA
  misc_feature 6..13: note = DNA
  misc_feature 14..18: note = RNA
cagaggtgaagcgaagtg

SEQ ID NO: 32 - DNA, 16 bp, synthetic construct
  source 1..16: mol_type = other DNA
  modified_base 1: mod_base = OTHER; note = Locked nucleic acid with adenine base
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 11: mod_base = OTHER; note = 2'-deoxy 5-methylcytidine
  modified_base 13: mod_base = OTHER; note = 2'-O-methoxyethyl adenosine
  modified_base 14: mod_base = OTHER; note = Locked nucleic acid with adenine base
  modified_base 15: mod_base = OTHER; note = Locked nucleic acid with guanine base
  modified_base 16: mod_base = OTHER; note = 2'-O-methoxyethyl thymidine
  misc_feature 1..4: note = RNA
  misc_feature 5..12: note = DNA
  misc_feature 13..16: note = RNA
agaggtgaagcgaagt

SEQ ID NO: 33 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'fluoro 2'-deoxy guanosine
  modified_base 7: mod_base = OTHER; note = 2'fluoro 2'-deoxy guanosine
  modified_base 9: mod_base = OTHER; note = 2'fluoro 2'-deoxy guanosine
  modified_base 10: mod_base = OTHER; note = 2'-fluoro 2'-deoxyadenosine
  modified_base 11: mod_base = OTHER; note = 2'-fluoro 2'-deoxyadenosine
  modified_base 12: mod_base = OTHER; note = 2'fluoro 2'-deoxy guanosine
  modified_base 13: mod_base = OTHER; note = 2'fluoro 2'-deoxy cytidine
  modified_base 14: mod_base = OTHER; note = 2'fluoro 2'-deoxy guanosine
  modified_base 15: mod_base = OTHER; note = 2'-fluoro 2'-deoxyadenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..7: note = RNA
  misc_feature 8: note = DNA
  misc_feature 9..20: note = RNA
gcagaggtgaagcgaagtgc

SEQ ID NO: 34 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'fluoro 2'-deoxy guanosine
  modified_base 10: mod_base = OTHER; note = 2'-fluoro 2'-deoxyadenosine
  modified_base 12: mod_base = OTHER; note = 2'fluoro 2'-deoxy guanosine
  modified_base 13: mod_base = OTHER; note = 2'-deoxy 5-methylcytidine
  modified_base 14: mod_base = OTHER; note = 2'fluoro 2'-deoxy guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..9: note = DNA
  misc_feature 10: note = RNA
  misc_feature 11: note = DNA
  misc_feature 12: note = RNA
  misc_feature 13: note = DNA
  misc_feature 14: note = RNA
  misc_feature 15: note = DNA
  misc_feature 16..20: note = RNA
gcagaggtgaagcgaagtgc

SEQ ID NO: 35 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'fluoro 2'-deoxy guanosine
  modified_base 10: mod_base = OTHER; note = 2'-fluoro 2'-deoxyadenosine
  modified_base 13: mod_base = OTHER; note = 2'-deoxy 5-methylcytidine
  modified_base 14: mod_base = OTHER; note = 2'fluoro 2'-deoxy guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..9: note = DNA
  misc_feature 10: note = RNA
  misc_feature 11..13: note = DNA
  misc_feature 14: note = RNA
  misc_feature 15: note = DNA
  misc_feature 16..20: note = RNA
gcagaggtgaagcgaagtgc

SEQ ID NO: 36 - DNA, 20 bp, synthetic construct
  source 1..20: mol_type = other DNA
  modified_base 1: mod_base = OTHER; note = 2'fluoro 2'-deoxy guanosine
  modified_base 2: mod_base = OTHER; note = 2'-deoxy 5-methylcytidine
  modified_base 3: mod_base = OTHER; note = 2'-fluoro 2'-deoxyadenosine
  modified_base 5: mod_base = OTHER; note = 2'-fluoro 2'-deoxyadenosine
  modified_base 7: mod_base = OTHER; note = 2'fluoro 2'-deoxy guanosine
  modified_base 9: mod_base = OTHER; note = 2'fluoro 2'-deoxy guanosine
  modified_base 11: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-O-methoxyethyl 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6: note = DNA
  misc_feature 7: note = RNA
  misc_feature 8: note = DNA
  misc_feature 9: note = RNA
  misc_feature 10: note = DNA
  misc_feature 11..20: note = RNA
gcagaggtgaagcgaagtgc

SEQ ID NO: 37 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl thymidine
  modified_base 7: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gacgtgcagaggtgaagcga

SEQ ID NO: 38 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
acgtgcagaggtgaagcgaa

SEQ ID NO: 39 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cgtgcagaggtgaagcgaag

SEQ ID NO: 40 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
gtgcagaggtgaagcgaagt

SEQ ID NO: 41 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
tgcagaggtgaagcgaagtg

SEQ ID NO: 42 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 43 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 44 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 45 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..14: note = DNA
  misc_feature 15..20: note = RNA
gcagaggtgaagcgaagtgc

SEQ ID NO: 46 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-O-methoxyethyl guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..13: note = DNA
  misc_feature 14: note = RNA
  misc_feature 15: note = DNA
  misc_feature 16..20: note = RNA
gcagaggtgaagcgaagtgc

SEQ ID NO: 47 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-O-methoxyethyl 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..12: note = DNA
  misc_feature 13: note = RNA
  misc_feature 14..15: note = DNA
  misc_feature 16..20: note = RNA
gcagaggtgaagcgaagtgc

SEQ ID NO: 48 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..11: note = DNA
  misc_feature 12: note = RNA
  misc_feature 13..15: note = DNA
  misc_feature 16..20: note = RNA
gcagaggtgaagcgaagtgc

SEQ ID NO: 49 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 50 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 51 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10..15: note = DNA
  misc_feature 16..20: note = RNA
gcagaggtgaagcgaagtgc

SEQ ID NO: 52 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-O-methoxyethyl thymidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..15: note = DNA
  misc_feature 16..20: note = RNA
gcagaggtgaagcgaagtgc

SEQ ID NO: 53 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..15: note = DNA
  misc_feature 16..20: note = RNA
gcagaggtgaagcgaagtgc

SEQ ID NO: 54 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..15: note = DNA
  misc_feature 16..20: note = RNA
gcagaggtgaagcgaagtgc

SEQ ID NO: 55 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-O-methoxyethyl guanosine
  modified_base 13: mod_base = OTHER; note = 2'-deoxy 5-methylcytidine
  modified_base 14: mod_base = OTHER; note = 2'-O-methoxyethyl guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..13: note = DNA
  misc_feature 14: note = RNA
  misc_feature 15: note = DNA
  misc_feature 16..20: note = RNA
gcagaggtgaagcgaagtgc

SEQ ID NO: 56 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-O-methoxyethyl thymidine
  modified_base 13: mod_base = OTHER; note = 2'-O-methoxyethyl 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..12: note = DNA
  misc_feature 13: note = RNA
  misc_feature 14..15: note = DNA
  misc_feature 16..20: note = RNA
gcagaggtgaagcgaagtgc

SEQ ID NO: 57 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-O-methoxyethyl guanosine
  modified_base 12: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10..11: note = DNA
  misc_feature 12: note = RNA
  misc_feature 13..15: note = DNA
  misc_feature 16..20: note = RNA
gcagaggtgaagcgaagtgc

SEQ ID NO: 58 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10..11: note = RNA
  misc_feature 12..15: note = DNA
  misc_feature 16..20: note = RNA
gcagaggtgaagcgaagtgc

SEQ ID NO: 59 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11: note = DNA
  misc_feature 12: note = RNA
  misc_feature 13..15: note = DNA
  misc_feature 16..20: note = RNA
gcagaggtgaagcgaagtgc

SEQ ID NO: 60 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-O-methoxyethyl 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..12: note = DNA
  misc_feature 13: note = RNA
  misc_feature 14..15: note = DNA
  misc_feature 16..20: note = RNA
gcagaggtgaagcgaagtgc

SEQ ID NO: 61 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-O-methoxyethyl guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..13: note = DNA
  misc_feature 14: note = RNA
  misc_feature 15: note = DNA
  misc_feature 16..20: note = RNA
gcagaggtgaagcgaagtgc

SEQ ID NO: 62 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 63 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-O-methoxyethyl guanosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10: note = DNA
  misc_feature 11: note = RNA
  misc_feature 12..15: note = DNA
  misc_feature 16..20: note = RNA
gcagaggtgaagcgaagtgc

SEQ ID NO: 64 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-O-methoxyethyl thymidine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..10: note = DNA
  misc_feature 11: note = RNA
  misc_feature 12..15: note = DNA
  misc_feature 16..20: note = RNA
gcagaggtgaagcgaagtgc

SEQ ID NO: 65 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-O-methoxyethyl guanosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..10: note = DNA
  misc_feature 11: note = RNA
  misc_feature 12..15: note = DNA
  misc_feature 16..20: note = RNA
gcagaggtgaagcgaagtgc

SEQ ID NO: 66 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 67 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-O-methoxyethyl 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..9: note = DNA
  misc_feature 10: note = RNA
  misc_feature 11..12: note = DNA
  misc_feature 13: note = RNA
  misc_feature 14..15: note = DNA
  misc_feature 16..20: note = RNA
gcagaggtgaagcgaagtgc

SEQ ID NO: 68 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-O-methoxyethyl thymidine
  modified_base 11: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-O-methoxyethyl guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..10: note = DNA
  misc_feature 11: note = RNA
  misc_feature 12..13: note = DNA
  misc_feature 14: note = RNA
  misc_feature 15: note = DNA
  misc_feature 16..20: note = RNA
gcagaggtgaagcgaagtgc

SEQ ID NO: 69 - DNA, 40 bp, synthetic construct
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..40: note = RNA
gcagaggtgaagcgaagtgcaacacaacacaacacaacac

SEQ ID NO: 70 - DNA, 40 bp, synthetic construct; identical to SEQ ID NO: 69
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..40: note = RNA

SEQ ID NO: 71 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'fluoro 2'-deoxy guanosine
  modified_base 13: mod_base = OTHER; note = 2'-deoxy 5-methylcytidine
  modified_base 14: mod_base = OTHER; note = 2'fluoro 2'-deoxy guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..13: note = DNA
  misc_feature 14: note = RNA
  misc_feature 15: note = DNA
  misc_feature 16..20: note = RNA
gcagaggtgaagcgaagtgc

SEQ ID NO: 72 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'fluoro 2'-deoxy guanosine
  modified_base 13: mod_base = OTHER; note = 2'-deoxy 5-methylcytidine
  modified_base 14: mod_base = OTHER; note = 2'fluoro 2'-deoxy guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10..13: note = DNA
  misc_feature 14: note = RNA
  misc_feature 15: note = DNA
  misc_feature 16..20: note = RNA
gcagaggtgaagcgaagtgc

SEQ ID NO: 73 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..6: note = RNA
  misc_feature 7..15: note = DNA
  misc_feature 16..20: note = RNA
gtgaagcgaagtgcacacgg

SEQ ID NO: 74 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-O-methoxyethyl 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6: note = DNA
  misc_feature 7: note = RNA
  misc_feature 8..15: note = DNA
  misc_feature 16..20: note = RNA
gtgaagcgaagtgcacacgg

SEQ ID NO: 75 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 8: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..7: note = DNA
  misc_feature 8: note = RNA
  misc_feature 9..15: note = DNA
  misc_feature 16..20: note = RNA
gtgaagcgaagtgcacacgg

SEQ ID NO: 76 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 9: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..8: note = DNA
  misc_feature 9: note = RNA
  misc_feature 10..15: note = DNA
  misc_feature 16..20: note = RNA
gtgaagcgaagtgcacacgg

SEQ ID NO: 77 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10: note = RNA
  misc_feature 11..15: note = DNA
  misc_feature 16..20: note = RNA
gtgaagcgaagtgcacacgg

SEQ ID NO: 78 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..10: note = DNA
  misc_feature 11: note = RNA
  misc_feature 12..15: note = DNA
  misc_feature 16..20: note = RNA
gtgaagcgaagtgcacacgg

SEQ ID NO: 79 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 12: mod_base = OTHER; note = 2'-O-methoxyethyl thymidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..11: note = DNA
  misc_feature 12: note = RNA
  misc_feature 13..15: note = DNA
  misc_feature 16..20: note = RNA
gtgaagcgaagtgcacacgg

SEQ ID NO: 80 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 13: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..12: note = DNA
  misc_feature 13: note = RNA
  misc_feature 14..15: note = DNA
  misc_feature 16..20: note = RNA
gtgaagcgaagtgcacacgg

SEQ ID NO: 81 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-O-methoxyethyl 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..13: note = DNA
  misc_feature 14: note = RNA
  misc_feature 15: note = DNA
  misc_feature 16..20: note = RNA
gtgaagcgaagtgcacacgg

SEQ ID NO: 82 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..14: note = DNA
  misc_feature 15..20: note = RNA
gtgaagcgaagtgcacacgg

SEQ ID NO: 83 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10..11: note = RNA
  misc_feature 12..15: note = DNA
  misc_feature 16..20: note = RNA
gtgaagcgaagtgcacacgg

SEQ ID NO: 84 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 12: mod_base = OTHER; note = 2'-O-methoxyethyl thymidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10: note = RNA
  misc_feature 11: note = DNA
  misc_feature 12: note = RNA
  misc_feature 13..15: note = DNA
  misc_feature 16..20: note = RNA
gtgaagcgaagtgcacacgg

SEQ ID NO: 85 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 13: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10: note = RNA
  misc_feature 11..12: note = DNA
  misc_feature 13: note = RNA
  misc_feature 14..15: note = DNA
  misc_feature 16..20: note = RNA
gtgaagcgaagtgcacacgg

SEQ ID NO: 86 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 14: mod_base = OTHER; note = 2'-O-methoxyethyl 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10: note = RNA
  misc_feature 11..13: note = DNA
  misc_feature 14: note = RNA
  misc_feature 15: note = DNA
  misc_feature 16..20: note = RNA
gtgaagcgaagtgcacacgg

SEQ ID NO: 87 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 14: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10: note = RNA
  misc_feature 11..14: note = DNA
  misc_feature 15..20: note = RNA
gtgaagcgaagtgcacacgg

SEQ ID NO: 88 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 9: mod_base = OTHER; note = 2'-O-methoxyethyl adenosine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..8: note = DNA
  misc_feature 9: note = RNA
  misc_feature 10: note = DNA
  misc_feature 11: note = RNA
  misc_feature 12..15: note = DNA
  misc_feature 16..20: note = RNA
gtgaagcgaagtgcacacgg

SEQ ID NO: 89 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 8: mod_base = OTHER; note = 2'-O-methoxyethyl guanosine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..7: note = DNA
  misc_feature 8: note = RNA
  misc_feature 9..10: note = DNA
  misc_feature 11: note = RNA
  misc_feature 12..15: note = DNA
  misc_feature 16..20: note = RNA
gtgaagcgaagtgcacacgg

SEQ ID NO: 90 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-O-methoxyethyl 5-methylcytidine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6: note = DNA
  misc_feature 7: note = RNA
  misc_feature 8..10: note = DNA
  misc_feature 11: note = RNA
  misc_feature 12..15: note = DNA
  misc_feature 16..20: note = RNA
gtgaagcgaagtgcacacgg

SEQ ID NO: 91 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-deoxy 5-methylcytidine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..6: note = RNA
  misc_feature 7..10: note = DNA
  misc_feature 11: note = RNA
  misc_feature 12..15: note = DNA
  misc_feature 16..20: note = RNA
gtgaagcgaagtgcacacgg

SEQ ID NO: 92 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-deoxy 5-methylcytidine
  modified_base 10: mod_base = OTHER; note = 2'-O-methoxyethyl adenosine
  modified_base 14: mod_base = OTHER; note = 2'-O-methoxyethyl 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..6: note = RNA
  misc_feature 7..9: note = DNA
  misc_feature 10: note = RNA
  misc_feature 11..13: note = DNA
  misc_feature 14: note = RNA
  misc_feature 15: note = DNA
  misc_feature 16..20: note = RNA
gtgaagcgaagtgcacacgg

SEQ ID NO: 93 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-O-methoxyethyl 5-methylcytidine
  modified_base 11: mod_base = OTHER; note = 2'-O-methoxyethyl guanosine
  modified_base 14: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6: note = DNA
  misc_feature 7: note = RNA
  misc_feature 8..10: note = DNA
  misc_feature 11: note = RNA
  misc_feature 12..14: note = DNA
  misc_feature 15..20: note = RNA
gtgaagcgaagtgcacacgg

SEQ ID NO: 94 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-O-methoxyethyl 5-methylcytidine
  modified_base 10: mod_base = OTHER; note = 2'-O-methoxyethyl adenosine
  modified_base 13: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6: note = DNA
  misc_feature 7: note = RNA
  misc_feature 8..9: note = DNA
  misc_feature 10: note = RNA
  misc_feature 11..12: note = DNA
  misc_feature 13: note = RNA
  misc_feature 14..15: note = DNA
  misc_feature 16..20: note = RNA
gtgaagcgaagtgcacacgg

SEQ ID NO: 95 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 8: mod_base = OTHER; note = 2'-O-methoxyethyl guanosine
  modified_base 11: mod_base = OTHER; note = 2'-O-methoxyethyl guanosine
  modified_base 14: mod_base = OTHER; note = 2'-O-methoxyethyl 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..7: note = DNA
  misc_feature 8: note = RNA
  misc_feature 9..10: note = DNA
  misc_feature 11: note = RNA
  misc_feature 12..13: note = DNA
  misc_feature 14: note = RNA
  misc_feature 15: note = DNA
  misc_feature 16..20: note = RNA
gtgaagcgaagtgcacacgg

SEQ ID NO: 96 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-OH guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..15: note = DNA
  misc_feature 16..20: note = RNA
gcagaggtgaagcgaagtgc

SEQ ID NO: 97 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-OH guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..15: note = DNA
  misc_feature 16..20: note = RNA
gcagaggtgaagcgaagtgc

SEQ ID NO: 98 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-OH uridine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..15: note = DNA
  misc_feature 16..20: note = RNA
gcagaggtgaagcgaagtgc

SEQ ID NO: 99 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-OH guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10..15: note = DNA
  misc_feature 16..20: note = RNA
gcagaggtgaagcgaagtgc

SEQ ID NO: 100 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-OH adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 101 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-OH adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 102 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 12: mod_base = OTHER; note = 2'-OH guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..11: note = DNA
  misc_feature 12: note = RNA
  misc_feature 13..15: note = DNA
  misc_feature 16..20: note = RNA
gcagaggtgaagcgaagtgc

SEQ ID NO: 103 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-OH 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..12: note = DNA
  misc_feature 13: note = RNA
  misc_feature 14..15: note = DNA
  misc_feature 16..20: note = RNA
gcagaggtgaagcgaagtgc

SEQ ID NO: 104 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-OH guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..13: note = DNA
  misc_feature 14: note = RNA
  misc_feature 15: note = DNA
  misc_feature 16..20: note = RNA
gcagaggtgaagcgaagtgc

SEQ ID NO: 105 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-OH adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..14: note = DNA
  misc_feature 15..20: note = RNA
gcagaggtgaagcgaagtgc

SEQ ID NO: 106 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggagaagcgaagtgc

SEQ ID NO: 107 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtcaagcgaagtgc

SEQ ID NO: 108 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgtagcgaagtgc

SEQ ID NO: 109 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgatgcgaagtgc

SEQ ID NO: 110 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 12: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaaccgaagtgc

SEQ ID NO: 111 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagggaagtgc

SEQ ID NO: 112 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagccaagtgc

SEQ ID NO: 113 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgtagtgc

SEQ ID NO: 114 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgatgtgc

SEQ ID NO: 115 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-OH guanosine
  modified_base 11: mod_base = OTHER; note = 2'-OH adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 116 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..15: note = DNA
  misc_feature 16..20: note = RNA
gcagaggtgaagcgaagtgc

SEQ ID NO: 117 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-O-methyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..15: note = DNA
  misc_feature 16..20: note = RNA
gcagaggtgaagcgaagtgc

SEQ ID NO: 118 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-O-methyl uridine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..15: note = DNA
  misc_feature 16..20: note = RNA
gcagaggtgaagcgaagtgc

SEQ ID NO: 119 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-O-methyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10..15: note = DNA
  misc_feature 16..20: note = RNA
gcagaggtgaagcgaagtgc

SEQ ID NO: 120 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 121 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 122 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 12: mod_base = OTHER; note = 2'-O-methyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..11: note = DNA
  misc_feature 12: note = RNA
  misc_feature 13..15: note = DNA
  misc_feature 16..20: note = RNA
gcagaggtgaagcgaagtgc

SEQ ID NO: 123 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-O-methyl 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..12: note = DNA
  misc_feature 13: note = RNA
  misc_feature 14..15: note = DNA
  misc_feature 16..20: note = RNA
gcagaggtgaagcgaagtgc

SEQ ID NO: 124 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-O-methyl guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..13: note = DNA
  misc_feature 14: note = RNA
  misc_feature 15: note = DNA
  misc_feature 16..20: note = RNA
gcagaggtgaagcgaagtgc

SEQ ID NO: 125 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..14: note = DNA
  misc_feature 15..20: note = RNA
gcagaggtgaagcgaagtgc

SEQ ID NO: 126 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 127 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 128 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 8: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggtccggcagatgagaaggc

SEQ ID NO: 129 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ccggcagatgagaaggcaca

SEQ ID NO: 130 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 9: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggcacagacggggagtccgc

SEQ ID NO: 131 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gtccgcgtaaagagaggtgc

SEQ ID NO: 132 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-F-ANA with thymine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..15: note = DNA
  misc_feature 16..20: note = RNA
gcagaggtgaagcgaagtgc

SEQ ID NO: 133 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-F-ANA with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 134 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-F-ANA with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 135 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-F-ANA with guanine base
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..13: note = DNA
  misc_feature 14: note = RNA
  misc_feature 15: note = DNA
  misc_feature 16..20: note = RNA
gcagaggtgaagcgaagtgc

SEQ ID NO: 136 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-F-ANA with adenine base
  modified_base 13: mod_base = OTHER; note = 2'-deoxy 5-methylcytidine
  modified_base 14: mod_base = OTHER; note = 2'-F-ANA with guanine base
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..13: note = DNA
  misc_feature 14: note = RNA
  misc_feature 15: note = DNA
  misc_feature 16..20: note = RNA
gcagaggtgaagcgaagtgc

SEQ ID NO: 137 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = Glycol nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 138 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = Glycol nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 139 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaactgc

SEQ ID NO: 140 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagagc

SEQ ID NO: 141 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtcc

SEQ ID NO: 142 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl guanosine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgg

SEQ ID NO: 143 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = Glycol nucleic acid with 5-methylcytidine base
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..12: note = DNA
  misc_feature 13: note = RNA
  misc_feature 14..15: note = DNA
  misc_feature 16..20: note = RNA
gcagaggtgaagcgaagtgc

SEQ ID NO: 144 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 145 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = Glycol nucleic acid with 5-methylcytidine base
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..12: note = DNA
  misc_feature 13: note = RNA
  misc_feature 14..15: note = DNA
  misc_feature 16..20: note = RNA
gcagaggtgaagcgaagtgc

SEQ ID NO: 146 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = Glycol nucleic acid with 5-methylcytidine base
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12: note = DNA
  misc_feature 13: note = RNA
  misc_feature 14..15: note = DNA
  misc_feature 16..20: note = RNA
gcagaggtgaagcgaagtgc

SEQ ID NO: 147 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 148 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = Glycol nucleic acid with 5-methylcytidine base
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12: note = DNA
  misc_feature 13: note = RNA
  misc_feature 14..15: note = DNA
  misc_feature 16..20: note = RNA
gcagaggtgaagcgaagtgc

SEQ ID NO: 149 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = Glycol nucleic acid with 5-methylcytidine base
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1..6: note = RNA
  misc_feature 7..10: note = DNA
  misc_feature 11: note = RNA
  misc_feature 12: note = DNA
  misc_feature 13: note = RNA
  misc_feature 14..15: note = DNA
  misc_feature 16..20: note = RNA
gcagaggtgaagcgaagtgc

SEQ ID NO: 150 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = Glycol nucleic acid with 5-methylcytidine base
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1..6: note = RNA
  misc_feature 7..10: note = DNA
  misc_feature 11: note = RNA
  misc_feature 12: note = DNA
  misc_feature 13: note = RNA
  misc_feature 14..15: note = DNA
  misc_feature 16..20: note = RNA
gcagaggtgaagcgaagtgc

SEQ ID NO: 151 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = Glycol nucleic acid with 5-methylcytidine base
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..12: note = DNA
  misc_feature 13: note = RNA
  misc_feature 14: note = DNA
  misc_feature 15..20: note = RNA
gcagaggtgaagcgaagtgc

SEQ ID NO: 152 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Glycol nucleic acid with 5-methylcytidine base
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = Glycol nucleic acid with 5-methylcytidine base
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1..6: note = RNA
  misc_feature 7..10: note = DNA
  misc_feature 11: note = RNA
  misc_feature 12: note = DNA
  misc_feature 13: note = RNA
  misc_feature 14..15: note = DNA
  misc_feature 16..20: note = RNA
gcagaggtgaagcgaagtgc

SEQ ID NO: 153 - DNA, 22 bp, synthetic construct
  source 1..22: mol_type = other DNA
  modified_base 4: mod_base = OTHER; note = 2'-deoxy cytidine
  modified_base 11: mod_base = OTHER; note = Glycol nucleic acid with 5-methylcytidine base
  modified_base 15: mod_base = OTHER; note = Glycol nucleic acid with 5-methylcytidine base
  misc_feature 1..10: note = DNA
  misc_feature 11: note = RNA
  misc_feature 12..14: note = DNA
  misc_feature 15: note = RNA
  misc_feature 16..22: note = DNA
tgactgtgaacgttcgagatga

SEQ ID NO: 154 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 155 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 156 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 157 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 158 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 159 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 160 - DNA, 19 bp, synthetic construct
  source 1..19: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 9: mod_base = OTHER; note = 2'-O-methoxyethyl adenosine
  modified_base 12: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl guanosine
  modified_base 19: mod_base = OTHER; note = 2'-O-methoxyethyl 5-methylcytidine
  misc_feature 1..4: note = RNA
  misc_feature 5..8: note = DNA
  misc_feature 9: note = RNA
  misc_feature 10..14: note = DNA
  misc_feature 15..19: note = RNA
gcagagtgaagcgaagtgc

SEQ ID NO: 161 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4..9: note = DNA
  misc_feature 10: note = RNA
  misc_feature 11..15: note = DNA
  misc_feature 16..20: note = RNA
gcagaggtgaagcgaagtgc

SEQ ID NO: 162 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 163 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 164 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..15: note = DNA
  misc_feature 16..20: note = RNA
gcagaggtgaagcgaagtgc

SEQ ID NO: 165 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6: note = DNA
  misc_feature 7: note = RNA
  misc_feature 8..15: note = DNA
  misc_feature 16..20: note = RNA
gcagaggtgaagcgaagtgc

SEQ ID NO: 166 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-O-methoxyethyl uridine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..7: note = DNA
  misc_feature 8: note = RNA
  misc_feature 9..15: note = DNA
  misc_feature 16..20: note = RNA
gcagaggtgaagcgaagtgc

SEQ ID NO: 167 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..8: note = DNA
  misc_feature 9: note = RNA
  misc_feature 10..15: note = DNA
  misc_feature 16..20: note = RNA
gcagaggtgaagcgaagtgc

SEQ ID NO: 168 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 169 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..11: note = DNA
  misc_feature 12: note = RNA
  misc_feature 13..15: note = DNA
  misc_feature 16..20: note = RNA
gcagaggtgaagcgaagtgc

SEQ ID NO: 170 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-O-methoxyethyl 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..12: note = DNA
  misc_feature 13: note = RNA
  misc_feature 14..15: note = DNA
  misc_feature 16..20: note = RNA
gcagaggtgaagcgaagtgc

SEQ ID NO: 171 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-O-methoxyethyl guanosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..13: note = DNA
  misc_feature 14: note = RNA
  misc_feature 15: note = DNA
  misc_feature 16..20: note = RNA
gcagaggtgaagcgaagtgc

SEQ ID NO: 172 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..14: note = DNA
  misc_feature 15..20: note = RNA
gcagaggtgaagcgaagtgc

SEQ ID NO: 173 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 174 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 175 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 176 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 11: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..10: note = DNA
  misc_feature 11: note = RNA
  misc_feature 12..15: note = DNA
  misc_feature 16..20: note = RNA
gcagaggtgaagcgaagtgc

SEQ ID NO: 177 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 178 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagtgaagtgc

SEQ ID NO: 179 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagtgaagtgc

SEQ ID NO: 180 - DNA, 40 bp, synthetic construct; identical to SEQ ID NO: 11
  source 1..40: mol_type = other DNA
  modified_base 1: mod_base = OTHER; note = 2'-O-methyl 5-methylcytidine
  modified_base 2: mod_base = OTHER; note = 2'-O-methyl adenosine
  modified_base 3: mod_base = OTHER; note = 2'-O-methyl adenosine
  modified_base 4: mod_base = OTHER; note = 2'-O-methyl adenosine
  modified_base 5: mod_base = OTHER; note = 2'-O-methyl 5-methylcytidine
  modified_base 6: mod_base = OTHER; note = 2'-O-methyl adenosine
  modified_base 7: mod_base = OTHER; note = 2'-O-methyl adenosine
  modified_base 8: mod_base = OTHER; note = 2'-O-methyl 5-methylcytidine
  modified_base 9: mod_base = OTHER; note = 2'-O-methyl adenosine
  modified_base 10: mod_base = OTHER; note = 2'-O-methyl adenosine
  modified_base 11: mod_base = OTHER; note = 2'-O-methyl guanosine
  modified_base 12: mod_base = OTHER; note = 2'-O-methyl 5-methylcytidine
  modified_base 13: mod_base = OTHER; note = 2'-O-methyl adenosine
  modified_base 14: mod_base = OTHER; note = 2'-O-methyl guanosine
  modified_base 15: mod_base = OTHER; note = 2'-O-methyl adenosine
  modified_base 23: mod_base = OTHER; note = 2'-deoxy cytidine
  modified_base 26: mod_base = OTHER; note = 2'-O-methyl adenosine
  modified_base 27: mod_base = OTHER; note = 2'-O-methyl guanosine
  modified_base 28: mod_base = OTHER; note = 2'-O-methyl thymidine
  modified_base 29: mod_base = OTHER; note = 2'-O-methyl guanosine
  modified_base 30: mod_base = OTHER; note = 2'-O-methyl 5-methylcytidine
  modified_base 31: mod_base = OTHER; note = 2'-O-methyl 5-methylcytidine
  modified_base 32: mod_base = OTHER; note = 2'-O-methyl adenosine
  modified_base 33: mod_base = OTHER; note = 2'-O-methyl adenosine
  modified_base 34: mod_base = OTHER; note = 2'-O-methyl 5-methylcytidine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl 5-methylcytidine
  modified_base 38: mod_base = OTHER; note = 2'-O-methyl adenosine
  modified_base 39: mod_base = OTHER; note = 2'-O-methyl adenosine
  modified_base 40: mod_base = OTHER; note = 2'-O-methyl adenosine
  misc_feature 1..15: note = RNA
  misc_feature 16..25: note = DNA
  misc_feature 26..40: note = RNA

SEQ ID NO: 181 - DNA, 40 bp, synthetic construct
  source 1..40: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-O-methoxyethyl adenosine
  modified_base 7: mod_base = OTHER; note = 2'-O-methoxyethyl 5-methylcytidine
  modified_base 8: mod_base = OTHER; note = 2'-O-methoxyethyl adenosine
  modified_base 9: mod_base = OTHER; note = 2'-O-methoxyethyl adenosine
  modified_base 10: mod_base = OTHER; note = 2'-O-methoxyethyl adenosine
  modified_base 11: mod_base = OTHER; note = 2'-O-methoxyethyl guanosine
  modified_base 12: mod_base = OTHER; note = 2'-O-methoxyethyl 5-methylcytidine
  modified_base 13: mod_base = OTHER; note = 2'-O-methoxyethyl adenosine
  modified_base 14: mod_base = OTHER; note = 2'-O-methoxyethyl guanosine
  modified_base 15: mod_base = OTHER; note = 2'-O-methoxyethyl adenosine
  modified_base 23: mod_base = OTHER; note = 2'-deoxy 5-methylcytidine
  modified_base 26: mod_base = OTHER; note = 2'-O-methoxyethyl adenosine
  modified_base 27: mod_base = OTHER; note = 2'-O-methoxyethyl guanosine
  modified_base 28: mod_base = OTHER; note = 2'-O-methoxyethyl thymidine
  modified_base 29: mod_base = OTHER; note = 2'-O-methoxyethyl guanosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl adenosine
  modified_base 37: mod_base = OTHER; note = 2'-O-methoxyethyl 5-methylcytidine
  modified_base 38: mod_base = OTHER; note = 2'-O-methoxyethyl adenosine
  modified_base 39: mod_base = OTHER; note = 2'-O-methoxyethyl adenosine
  modified_base 40: mod_base = OTHER; note = 2'-O-methoxyethyl adenosine
  misc_feature 1..15: note = RNA
  misc_feature 16..25: note = DNA
  misc_feature 26..40: note = RNA
aaacaacaaagcagaggtgaagcgaagtgcaaacaacaaa

SEQ ID NO: 182 - DNA, 40 bp, synthetic construct; identical to SEQ ID NO: 181
  source 1..40: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-O-methoxyethyl adenosine
  modified_base 7: mod_base = OTHER; note = 2'-O-methoxyethyl 5-methylcytidine
  modified_base 8: mod_base = OTHER; note = 2'-O-methoxyethyl adenosine
  modified_base 9: mod_base = OTHER; note = 2'-O-methoxyethyl adenosine
  modified_base 10: mod_base = OTHER; note = 2'-O-methoxyethyl adenosine
  modified_base 12: mod_base = OTHER; note = 2'-deoxy 5-methylcytidine
  modified_base 23: mod_base = OTHER; note = 2'-deoxy 5-methylcytidine
  modified_base 30: mod_base = OTHER; note = 2'-deoxy 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl adenosine
  modified_base 37: mod_base = OTHER; note = 2'-O-methoxyethyl 5-methylcytidine
  modified_base 38: mod_base = OTHER; note = 2'-O-methoxyethyl adenosine
  modified_base 39: mod_base = OTHER; note = 2'-O-methoxyethyl adenosine
  modified_base 40: mod_base = OTHER; note = 2'-O-methoxyethyl adenosine
  misc_feature 1..10: note = RNA
  misc_feature 11..30: note = DNA
  misc_feature 31..40: note = RNA

SEQ ID NO: 183 - DNA, 30 bp, synthetic construct
  source 1..30: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl 5-methylcytidine
  modified_base 8: mod_base = OTHER; note = 2'-O-methoxyethyl adenosine
  modified_base 9: mod_base = OTHER; note = 2'-O-methoxyethyl guanosine
  modified_base 10: mod_base = OTHER; note = 2'-O-methoxyethyl adenosine
  modified_base 18: mod_base = OTHER; note = 2'-deoxy 5-methylcytidine
  modified_base 21: mod_base = OTHER; note = 2'-O-methoxyethyl adenosine
  modified_base 22: mod_base = OTHER; note = 2'-O-methoxyethyl guanosine
  modified_base 23: mod_base = OTHER; note = 2'-O-methoxyethyl thymidine
  modified_base 24: mod_base = OTHER; note = 2'-O-methoxyethyl guanosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl adenosine
  modified_base 29: mod_base = OTHER; note = 2'-O-methoxyethyl 5-methylcytidine
  modified_base 30: mod_base = OTHER; note = 2'-O-methoxyethyl adenosine
  misc_feature 1..10: note = RNA
  misc_feature 11..20: note = DNA
  misc_feature 21..30: note = RNA
acaaagcagaggtgaagcgaagtgcaaaca

SEQ ID NO: 184 - DNA, 30 bp, synthetic construct; identical to SEQ ID NO: 183
  source 1..30: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 18: mod_base = OTHER; note = 2'-deoxy 5-methylcytidine
  modified_base 25: mod_base = OTHER; note = 2'-deoxy 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl adenosine
  modified_base 29: mod_base = OTHER; note = 2'-O-methoxyethyl 5-methylcytidine
  modified_base 30: mod_base = OTHER; note = 2'-O-methoxyethyl adenosine
  misc_feature 1..5: note = RNA
  misc_feature 6..25: note = DNA
  misc_feature 26..30: note = RNA

SEQ ID NO: 185 - DNA, 40 bp, synthetic construct; identical to SEQ ID NO: 12
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl adenosine
  modified_base 26: mod_base = OTHER; note = 2'-O-methoxyethyl adenosine
  modified_base 27: mod_base = OTHER; note = 2'-O-methoxyethyl 5-methylcytidine
  modified_base 28: mod_base = OTHER; note = 2'-O-methoxyethyl adenosine
  modified_base 29: mod_base = OTHER; note = 2'-O-methoxyethyl adenosine
  modified_base 30: mod_base = OTHER; note = 2'-O-methoxyethyl adenosine
  modified_base 31: mod_base = OTHER; note = 2'-O-methoxyethyl 5-methylcytidine
  modified_base 32: mod_base = OTHER; note = 2'-O-methoxyethyl adenosine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl adenosine
  misc_feature 1..5: note = RNA
  misc_feature 6..15: note = DNA
  misc_feature 16..40: note = RNA

SEQ ID NO: 186 - DNA, 30 bp, synthetic construct
  source 1..30: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl adenosine
  modified_base 26: mod_base = OTHER; note = 2'-O-methoxyethyl adenosine
  modified_base 27: mod_base = OTHER; note = 2'-O-methoxyethyl 5-methylcytidine
  modified_base 28: mod_base = OTHER; note = 2'-O-methoxyethyl adenosine
  modified_base 29: mod_base = OTHER; note = 2'-O-methoxyethyl adenosine
  modified_base 30: mod_base = OTHER; note = 2'-O-methoxyethyl adenosine
  misc_feature 1..5: note = RNA
  misc_feature 6..15: note = DNA
  misc_feature 16..30: note = RNA
gcagaggtgaagcgaagtgcaaacaacaaa

SEQ ID NO: 187 - DNA, 40 bp, synthetic construct
  source 1..40: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methoxyethyl adenosine
  modified_base 7: mod_base = OTHER; note = 2'-O-methoxyethyl 5-methylcytidine
  modified_base 8: mod_base = OTHER; note = 2'-O-methoxyethyl adenosine
  modified_base 9: mod_base = OTHER; note = 2'-O-methoxyethyl adenosine
  modified_base 10: mod_base = OTHER; note = 2'-O-methoxyethyl 5-methylcytidine
  modified_base 11: mod_base = OTHER; note = 2'-O-methoxyethyl adenosine
  modified_base 12: mod_base = OTHER; note = 2'-O-methoxyethyl adenosine
  modified_base 13: mod_base = OTHER; note = 2'-O-methoxyethyl adenosine
  modified_base 14: mod_base = OTHER; note = 2'-O-methoxyethyl 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl adenosine
  modified_base 21: mod_base = OTHER; note = 2'-O-methoxyethyl guanosine
  modified_base 22: mod_base = OTHER; note = 2'-O-methoxyethyl 5-methylcytidine
  modified_base 23: mod_base = OTHER; note = 2'-O-methoxyethyl adenosine
  modified_base 24: mod_base = OTHER; note = 2'-O-methoxyethyl guanosine
  modified_base 25: mod_base = OTHER; note = 2'-O-methoxyethyl adenosine
  modified_base 33: mod_base = OTHER; note = 2'-deoxy 5-methylcytidine
  modified_base 36: mod_base = OTHER; note = 2'-O-methoxyethyl adenosine
  modified_base 37: mod_base = OTHER; note = 2'-O-methoxyethyl guanosine
  modified_base 38: mod_base = OTHER; note = 2'-O-methoxyethyl thymidine
  modified_base 39: mod_base = OTHER; note = 2'-O-methoxyethyl guanosine
  modified_base 40: mod_base = OTHER; note = 2'-O-methoxyethyl 5-methylcytidine
  misc_feature 1..25: note = RNA
  misc_feature 26..35: note = DNA
  misc_feature 36..40: note = RNA
aacaaacaacaaacaacaaagcagaggtgaagcgaagtgc

SEQ ID NO: 188 - DNA, 30 bp, synthetic construct
  source 1..30: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-O-methoxyethyl adenosine
  modified_base 7: mod_base = OTHER; note = 2'-O-methoxyethyl 5-methylcytidine
  modified_base 8: mod_base = OTHER; note = 2'-O-methoxyethyl adenosine
  modified_base 9: mod_base = OTHER; note = 2'-O-methoxyethyl adenosine
  modified_base 10: mod_base = OTHER; note = 2'-O-methoxyethyl adenosine
  modified_base 11: mod_base = OTHER; note = 2'-O-methoxyethyl guanosine
  modified_base 12: mod_base = OTHER; note = 2'-O-methoxyethyl 5-methylcytidine
  modified_base 13: mod_base = OTHER; note = 2'-O-methoxyethyl adenosine
  modified_base 14: mod_base = OTHER; note = 2'-O-methoxyethyl guanosine
  modified_base 15: mod_base = OTHER; note = 2'-O-methoxyethyl adenosine
  modified_base 23: mod_base = OTHER; note = 2'-deoxy 5-methylcytidine
  modified_base 26: mod_base = OTHER; note = 2'-O-methoxyethyl adenosine
  modified_base 27: mod_base = OTHER; note = 2'-O-methoxyethyl guanosine
  modified_base 28: mod_base = OTHER; note = 2'-O-methoxyethyl thymidine
  modified_base 29: mod_base = OTHER; note = 2'-O-methoxyethyl guanosine
  modified_base 30: mod_base = OTHER; note = 2'-O-methoxyethyl 5-methylcytidine
  misc_feature 1..15: note = RNA
  misc_feature 16..25: note = DNA
  misc_feature 26..30: note = RNA
aaacaacaaagcagaggtgaagcgaagtgc

SEQ ID NO: 189 - DNA, 26 bp, synthetic construct
  source 1..26: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 6: mod_base = OTHER; note = 2'-O-methoxyethyl adenosine
  modified_base 7: mod_base = OTHER; note = 2'-O-methoxyethyl guanosine
  modified_base 8: mod_base = OTHER; note = 2'-O-methoxyethyl adenosine
  modified_base 16: mod_base = OTHER; note = 2'-deoxy 5-methylcytidine
  modified_base 19: mod_base = OTHER; note = 2'-O-methoxyethyl adenosine
  modified_base 20: mod_base = OTHER; note = 2'-O-methoxyethyl guanosine
  modified_base 21: mod_base = OTHER; note = 2'-O-methoxyethyl thymidine
  modified_base 22: mod_base = OTHER; note = 2'-O-methoxyethyl guanosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  misc_feature 1..8: note = RNA
  misc_feature 9..18: note = DNA
  misc_feature 19..26: note = RNA
cgtgcagaggtgaagcgaagtgcaca

SEQ ID NO: 190 - DNA, 24 bp, synthetic construct
  source 1..24: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl adenosine
  modified_base 15: mod_base = OTHER; note = 2'-deoxy 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl thymidine
  modified_base 21: mod_base = OTHER; note = 2'-O-methoxyethyl guanosine
  modified_base 22: mod_base = OTHER; note = 2'-O-methoxyethyl 5-methylcytidine
  modified_base 23: mod_base = OTHER; note = 2'-O-methoxyethyl adenosine
  modified_base 24: mod_base = OTHER; note = 2'-O-methoxyethyl 5-methylcytidine
  misc_feature 1..7: note = RNA
  misc_feature 8..17: note = DNA
  misc_feature 18..24: note = RNA
gtgcagaggtgaagcgaagtgcac

SEQ ID NO: 191 - DNA, 22 bp, synthetic construct
  source 1..22: mol_type = other DNA
  modified_base 1: mod_base = OTHER; note = 2'-O-methoxyethyl thymidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 6: mod_base = OTHER; note = 2'-O-methoxyethyl adenosine
  modified_base 14: mod_base = OTHER; note = 2'-deoxy 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl guanosine
  modified_base 21: mod_base = OTHER; note = 2'-O-methoxyethyl 5-methylcytidine
  modified_base 22: mod_base = OTHER; note = 2'-O-methoxyethyl adenosine
  misc_feature 1..6: note = RNA
  misc_feature 7..16: note = DNA
  misc_feature 17..22: note = RNA
tgcagaggtgaagcgaagtgca

SEQ ID NO: 192 - DNA, 18 bp, synthetic construct
  source 1..18: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl adenosine
  modified_base 12: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl guanosine
  misc_feature 1..4: note = RNA
  misc_feature 5..14: note = DNA
  misc_feature 15..18: note = RNA
cagaggtgaagcgaagtg

SEQ ID NO: 193 - DNA, 16 bp, synthetic construct
  source 1..16: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 11: mod_base = OTHER; note = 2'-deoxy 5-methylcytidine
  modified_base 14: mod_base = OTHER; note = 2'-O-methoxyethyl adenosine
  modified_base 15: mod_base = OTHER; note = 2'-O-methoxyethyl guanosine
  modified_base 16: mod_base = OTHER; note = 2'-O-methoxyethyl thymidine
  misc_feature 1..3: note = RNA
  misc_feature 4..13: note = DNA
  misc_feature 14..16: note = RNA
agaggtgaagcgaagt

SEQ ID NO: 194 - DNA, 14 bp, synthetic construct
  source 1..14: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 10: mod_base = OTHER; note = 2'-deoxy 5-methylcytidine
  modified_base 13: mod_base = OTHER; note = 2'-O-methoxyethyl adenosine
  modified_base 14: mod_base = OTHER; note = 2'-O-methoxyethyl guanosine
  misc_feature 1..2: note = RNA
  misc_feature 3..12: note = DNA
  misc_feature 13..14: note = RNA
gaggtgaagcgaag

SEQ ID NO: 195 - DNA, 25 bp, synthetic construct
  source 1..25: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  misc_feature 1..5: note = RNA
  misc_feature 6..15: note = DNA
  misc_feature 16..25: note = RNA
gcagaggtgaagcgaagtgcaacac

SEQ ID NO: 196 - DNA, 30 bp, synthetic construct
  source 1..30: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  misc_feature 1..5: note = RNA
  misc_feature 6..15: note = DNA
  misc_feature 16..30: note = RNA
gcagaggtgaagcgaagtgcaacacaacac

SEQ ID NO: 197 - DNA, 35 bp, synthetic construct
  source 1..35: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  misc_feature 1..5: note = RNA
  misc_feature 6..15: note = DNA
  misc_feature 16..35: note = RNA
gcagaggtgaagcgaagtgcaacacaacacaacac

SEQ ID NO: 198 - DNA, 40 bp, synthetic construct; identical to SEQ ID NO: 69
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA

SEQ ID NO: 199 - DNA, 45 bp, synthetic construct
  source 1..45: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  modified_base 41: mod_base = OTHER; note = 2'-O-methoxyethyl adenosine
  modified_base 42: mod_base = OTHER; note = 2'-O-methoxyethyl adenosine
  modified_base 43: mod_base = OTHER; note = 2'-O-methoxyethyl 5-methylcytidine
  modified_base 44: mod_base = OTHER; note = 2'-O-methoxyethyl adenosine
  modified_base 45: mod_base = OTHER; note = 2'-O-methoxyethyl 5-methylcytidine
  misc_feature 1..5: note = RNA
  misc_feature 6..15: note = DNA
  misc_feature 16..45: note = RNA
gcagaggtgaagcgaagtgcaacacaacacaacacaacacaacac

SEQ ID NO: 200 - DNA, 50 bp, synthetic construct
  source 1..50: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  modified_base 41: mod_base = OTHER; note = 2'-O-methoxyethyl adenosine
  modified_base 42: mod_base = OTHER; note = 2'-O-methoxyethyl adenosine
  modified_base 43: mod_base = OTHER; note = 2'-O-methoxyethyl 5-methylcytidine
  modified_base 44: mod_base = OTHER; note = 2'-O-methoxyethyl adenosine
  modified_base 45: mod_base = OTHER; note = 2'-O-methoxyethyl 5-methylcytidine
  modified_base 46: mod_base = OTHER; note = 2'-O-methoxyethyl adenosine
  modified_base 47: mod_base = OTHER; note = 2'-O-methoxyethyl adenosine
  modified_base 48: mod_base = OTHER; note = 2'-O-methoxyethyl 5-methylcytidine
  modified_base 49: mod_base = OTHER; note = 2'-O-methoxyethyl adenosine
  modified_base 50: mod_base = OTHER; note = 2'-O-methoxyethyl 5-methylcytidine
  misc_feature 1..5: note = RNA
  misc_feature 6..15: note = DNA
  misc_feature 16..50: note = RNA
gcagaggtgaagcgaagtgcaacacaacacaacacaacacaacacaacac

SEQ ID NO: 201 - DNA, 40 bp, synthetic construct; identical to SEQ ID NO: 12
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl adenosine
  modified_base 26: mod_base = OTHER; note = 2'-O-methoxyethyl adenosine
  modified_base 27: mod_base = OTHER; note = 2'-O-methoxyethyl 5-methylcytidine
  modified_base 28: mod_base = OTHER; note = 2'-O-methoxyethyl adenosine
  modified_base 29: mod_base = OTHER; note = 2'-O-methoxyethyl adenosine
  modified_base 30: mod_base = OTHER; note = 2'-O-methoxyethyl adenosine
  modified_base 31: mod_base = OTHER; note = 2'-O-methoxyethyl 5-methylcytidine
  modified_base 32: mod_base = OTHER; note = 2'-O-methoxyethyl adenosine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl adenosine
  misc_feature 1..5: note = RNA
  misc_feature 6..15: note = DNA
  misc_feature 16..40: note = RNA

SEQ ID NO: 202 - DNA, 40 bp, synthetic construct
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl 5-methylcytidine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl adenosine
  modified_base 26: mod_base = OTHER; note = 2'-O-methoxyethyl 5-methylcytidine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl 5-methylcytidine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl 5-methylcytidine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA
gcagaggtgaagcgaagtgcacacacacacacacacacac

SEQ ID NO: 203 - DNA, 40 bp, synthetic construct; identical to SEQ ID NO: 69
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA

SEQ ID NO: 204 - DNA, 40 bp, synthetic construct; identical to SEQ ID NO: 202
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl 5-methylcytidine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl adenosine
  modified_base 26: mod_base = OTHER; note = 2'-O-methoxyethyl 5-methylcytidine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl 5-methylcytidine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl 5-methylcytidine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA

SEQ ID NO: 205 - DNA, 19 bp, synthetic construct
  source 1..19: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  misc_feature 1..5: note = RNA
  misc_feature 6..9: note = DNA
  misc_feature 10: note = RNA
  misc_feature 11..15: note = DNA
  misc_feature 16..19: note = RNA
gcagaggtgaagcgaagtg

SEQ ID NO: 206 - DNA, 18 bp, synthetic construct
  source 1..18: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl adenosine
  modified_base 9: mod_base = OTHER; note = 2'-O-methoxyethyl adenosine
  modified_base 12: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl guanosine
  modified_base 17: mod_base = OTHER; note = 2'-O-methoxyethyl uridine
  modified_base 18: mod_base = OTHER; note = 2'-O-methoxyethyl guanosine
  misc_feature 1..4: note = RNA
  misc_feature 5..8: note = DNA
  misc_feature 9: note = RNA
  misc_feature 10..14: note = DNA
  misc_feature 15..18: note = RNA
cagaggtgaagcgaagtg

SEQ ID NO: 207 - DNA, 17 bp, synthetic construct
  source 1..17: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 8: mod_base = OTHER; note = 2'-O-methoxyethyl adenosine
  modified_base 11: mod_base = OTHER; note = 2'-deoxy 5-methylcytidine
  modified_base 14: mod_base = OTHER; note = 2'-O-methoxyethyl adenosine
  modified_base 15: mod_base = OTHER; note = 2'-O-methoxyethyl guanosine
  modified_base 16: mod_base = OTHER; note = 2'-O-methoxyethyl uridine
  modified_base 17: mod_base = OTHER; note = 2'-O-methoxyethyl guanosine
  misc_feature 1..3: note = RNA
  misc_feature 4..7: note = DNA
  misc_feature 8: note = RNA
  misc_feature 9..13: note = DNA
  misc_feature 14..17: note = RNA
agaggtgaagcgaagtg

SEQ ID NO: 208 - DNA, 17 bp, synthetic construct
  source 1..17: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl adenosine
  modified_base 9: mod_base = OTHER; note = 2'-O-methoxyethyl adenosine
  modified_base 12: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl guanosine
  modified_base 17: mod_base = OTHER; note = 2'-O-methoxyethyl uridine
  misc_feature 1..4: note = RNA
  misc_feature 5..8: note = DNA
  misc_feature 9: note = RNA
  misc_feature 10..14: note = DNA
  misc_feature 15..17: note = RNA
cagaggtgaagcgaagt

SEQ ID NO: 209 - DNA, 16 bp, synthetic construct
  source 1..16: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 8: mod_base = OTHER; note = 2'-O-methoxyethyl adenosine
  modified_base 11: mod_base = OTHER; note = 2'-deoxy 5-methylcytidine
  modified_base 14: mod_base = OTHER; note = 2'-O-methoxyethyl adenosine
  modified_base 15: mod_base = OTHER; note = 2'-O-methoxyethyl guanosine
  modified_base 16: mod_base = OTHER; note = 2'-O-methoxyethyl uridine
  misc_feature 1..3: note = RNA
  misc_feature 4..7: note = DNA
  misc_feature 8: note = RNA
  misc_feature 9..13: note = DNA
  misc_feature 14..16: note = RNA
agaggtgaagcgaagt

SEQ ID NO: 210 - DNA, 20 bp, synthetic construct
  source 1..20: mol_type = other DNA
  modified_base 2: mod_base = OTHER; note = 2'-deoxy cytidine
  modified_base 13: mod_base = OTHER; note = 2'-deoxy cytidine
  modified_base 20: mod_base = OTHER; note = 2'-deoxy cytidine
gcagaggtgaagcgaagtgc

SEQ ID NO: 211 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl guanosine
  modified_base 5: mod_base = OTHER; note = 2'-O-methyl adenosine
  modified_base 13: mod_base = OTHER; note = 2'-deoxy cytidine
  modified_base 16: mod_base = OTHER; note = 2'-O-methyl adenosine
  modified_base 17: mod_base = OTHER; note = 2'-O-methyl guanosine
  modified_base 18: mod_base = OTHER; note = 2'-O-methyl thymidine
  modified_base 19: mod_base = OTHER; note = 2'-O-methyl guanosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 212 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 213 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
aacaaggtgaagcgaagtgc

SEQ ID NO: 214 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gcagaggtgaagcgaaacaa

SEQ ID NO: 215 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl guanosine
  modified_base 5: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methyl adenosine
  modified_base 17: mod_base = OTHER; note = 2'-O-methyl guanosine
  modified_base 18: mod_base = OTHER; note = 2'-O-methyl uridine
  modified_base 19: mod_base = OTHER; note = 2'-O-methyl guanosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 216 - DNA, 20 bp, synthetic construct
  source 1..20: mol_type = other DNA
  modified_base 2: mod_base = OTHER; note = 2'-deoxy 5-methylcytidine
  modified_base 13: mod_base = OTHER; note = 2'-deoxy 5-methylcytidine
  modified_base 20: mod_base = OTHER; note = 2'-deoxy 5-methylcytidine
gcagaggtgaagcgaagtgc

SEQ ID NO: 217 - DNA, 30 bp, synthetic construct; identical to SEQ ID NO: 186
  source 1..30: mol_type = other DNA
  modified_base 2: mod_base = OTHER; note = 2'-deoxy 5-methylcytidine
  modified_base 13: mod_base = OTHER; note = 2'-deoxy 5-methylcytidine
  modified_base 20: mod_base = OTHER; note = 2'-deoxy 5-methylcytidine
  modified_base 24: mod_base = OTHER; note = 2'-deoxy 5-methylcytidine
  modified_base 27: mod_base = OTHER; note = 2'-deoxy 5-methylcytidine

SEQ ID NO: 218 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 219 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 220 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 221 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 222 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 223 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 224 - DNA, 20 bp, synthetic construct
  source 1..20: mol_type = other DNA
  modified_base 1: mod_base = OTHER; note = 2'fluoro 2'-deoxy guanosine
  modified_base 2: mod_base = OTHER; note = 2'fluoro 2'-deoxy cytidine
  modified_base 3: mod_base = OTHER; note = 2'-fluoro 2'-deoxyadenosine
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 225 - DNA, 40 bp, synthetic construct; identical to SEQ ID NO: 69
  source 1..40: mol_type = other DNA
  modified_base 1: mod_base = OTHER; note = 2'fluoro 2'-deoxy guanosine
  modified_base 2: mod_base = OTHER; note = 2'fluoro 2'-deoxy cytidine
  modified_base 3: mod_base = OTHER; note = 2'-fluoro 2'-deoxyadenosine
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA

SEQ ID NO: 226 - DNA, 20 bp, synthetic construct
  source 1..20: mol_type = other DNA
  modified_base 1: mod_base = OTHER; note = 2'fluoro 2'-deoxy guanosine
  modified_base 2: mod_base = OTHER; note = 2'fluoro 2'-deoxy cytidine
  modified_base 3: mod_base = OTHER; note = 2'fluoro 2'-deoxy guanosine
  modified_base 4: mod_base = OTHER; note = 2'-fluoro 2'-deoxyadenosine
  modified_base 5: mod_base = OTHER; note = 2'-fluoro 2'-deoxyadenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl uridine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcgaagtgcacacggtccgg

SEQ ID NO: 227 - DNA, 20 bp, synthetic construct
  source 1..20: mol_type = other DNA
  modified_base 1: mod_base = OTHER; note = 2'fluoro 2'-deoxy guanosine
  modified_base 2: mod_base = OTHER; note = 2'fluoro 2'-deoxy cytidine
  modified_base 3: mod_base = OTHER; note = 2'-fluoro 2'-deoxyadenosine
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 228 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'fluoro 2'-deoxy cytidine
  modified_base 3: mod_base = OTHER; note = 2'-fluoro 2'-deoxyadenosine
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 229 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-fluoro 2'-deoxyadenosine
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 230 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'fluoro 2'-deoxy cytidine
  modified_base 3: mod_base = OTHER; note = Locked nucleic acid with adenine base
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 231 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'fluoro 2'-deoxy cytidine
  modified_base 3: mod_base = OTHER; note = 2'-fluoro 2'-deoxyadenosine
  modified_base 4: mod_base = OTHER; note = Locked nucleic acid with guanine base
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 232 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'fluoro 2'-deoxy cytidine
  modified_base 3: mod_base = OTHER; note = 2'-fluoro 2'-deoxyadenosine
  modified_base 4: mod_base = OTHER; note = 2'fluoro 2'-deoxy guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 233 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = 2'fluoro 2'-deoxy guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 234 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'fluoro 2'-deoxy cytidine
  modified_base 3: mod_base = OTHER; note = 2'-O-methoxyethyl adenosine
  modified_base 4: mod_base = OTHER; note = 2'fluoro 2'-deoxy guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 235 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-fluoro 2'-deoxyadenosine
  modified_base 4: mod_base = OTHER; note = 2'-O-methoxyethyl guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 236 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-fluoro 2'-deoxyadenosine
  modified_base 4: mod_base = OTHER; note = 2'-O-methoxyethyl guanosine
  modified_base 5: mod_base = OTHER; note = 2'-fluoro 2'-deoxyadenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 237 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'fluoro 2'-deoxy guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 238 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 239 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 240 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 241 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 242 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggagaggtgaagcgaagtgc

SEQ ID NO: 243 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl thymidine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gctgaggtgaagcgaagtgc

SEQ ID NO: 244 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcacaggtgaagcgaagtgc

SEQ ID NO: 245 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl thymidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagtggtgaagcgaagtgc

SEQ ID NO: 246 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagacgtgaagcgaagtgc

SEQ ID NO: 247 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 7: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagagctgaagcgaagtgc

SEQ ID NO: 248 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ccagaggtgaagcgaagtgc

SEQ ID NO: 249 - DNA, 20 bp, synthetic construct
  source 1..20: mol_type = other DNA
  modified_base 1: mod_base = OTHER; note = 2'-F-ANA with guanine base
  modified_base 2: mod_base = OTHER; note = 2'-F-ANA with cytosine base
  modified_base 3: mod_base = OTHER; note = 2'-F-ANA with adenine base
  modified_base 4: mod_base = OTHER; note = 2'-F-ANA with guanine base
  modified_base 5: mod_base = OTHER; note = 2'-F-ANA with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 250 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-F-ANA with adenine base
  modified_base 4: mod_base = OTHER; note = 2'-F-ANA with guanine base
  modified_base 5: mod_base = OTHER; note = 2'-F-ANA with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 251 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 252 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 253 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 254 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 255 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 256 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 257 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 258 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 259 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 260 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 261 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 262 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 263 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 264 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 265 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 266 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 267 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 268 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 269 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 270 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 271 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 272 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 273 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy cytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 274 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy cytidine
  modified_base 3: mod_base = OTHER; note = 2'-O-methoxyethyl adenosine
  modified_base 4: mod_base = OTHER; note = 2'-OH guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 275 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 276 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 277 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 278 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 279 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 280 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 281 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 282 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 283 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 284 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 285 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 286 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = Locked nucleic acid with adenine base
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 287 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 288 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 289 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 290 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = Locked nucleic acid with adenine base
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 291 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 292 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 293 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = Locked nucleic acid with adenine base
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 294 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 295 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 296 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 297 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 298 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 299 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 300 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 301 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = Locked nucleic acid with adenine base
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 302 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = Locked nucleic acid with cytosine base
  misc_feature 1..5: note = RNA
  misc_feature 6..15: note = DNA
  misc_feature 16..20: note = RNA
gcagaggtgaagcgaagtgc

SEQ ID NO: 303 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-fluoro 2'-deoxyuridine
  modified_base 17: mod_base = OTHER; note = 2'fluoro 2'-deoxy cytidine
  modified_base 18: mod_base = OTHER; note = 2'fluoro 2'-deoxy cytidine
  modified_base 19: mod_base = OTHER; note = 2'fluoro 2'-deoxy guanosine
  modified_base 20: mod_base = OTHER; note = 2'fluoro 2'-deoxy guanosine
  misc_feature 1..5: note = RNA
  misc_feature 6..15: note = DNA
  misc_feature 16..20: note = RNA
gcgaagtgcacacggtccgg

SEQ ID NO: 304 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-fluoro 2'-deoxyadenosine
  modified_base 17: mod_base = OTHER; note = 2'fluoro 2'-deoxy guanosine
  modified_base 18: mod_base = OTHER; note = 2'-fluoro 2'-deoxyuridine
  modified_base 19: mod_base = OTHER; note = 2'fluoro 2'-deoxy guanosine
  modified_base 20: mod_base = OTHER; note = 2'fluoro 2'-deoxy cytidine
  misc_feature 1..5: note = RNA
  misc_feature 6..15: note = DNA
  misc_feature 16..20: note = RNA
gcagaggtgaagcgaagtgc

SEQ ID NO: 305 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 306 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 307 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 308 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 309 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 310 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 311 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with cytosine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 312 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 313 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with cytosine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 314 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with cytosine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 315 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 316 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with cytosine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 317 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with cytosine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 318 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = Locked nucleic acid with cytosine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 319 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 320 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 321 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with cytosine base
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 322 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 323 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with cytosine base
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 324 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with cytosine base
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 325 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 326 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with cytosine base
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 327 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with cytosine base
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 328 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = Locked nucleic acid with cytosine base
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 329 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 330 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 331 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 332 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = Locked nucleic acid with adenine base
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = Locked nucleic acid with cytosine base
  misc_feature 1..5: note = RNA
  misc_feature 6..15: note = DNA
  misc_feature 16..20: note = RNA
gcagaggtgaagcgaagtgc

SEQ ID NO: 333 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with cytosine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methoxyethyl guanosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl guanosine
  modified_base 10: mod_base = OTHER; note = 2'-O-methoxyethyl adenosine
  modified_base 11: mod_base = OTHER; note = 2'-O-methoxyethyl adenosine
  modified_base 12: mod_base = OTHER; note = 2'-O-methoxyethyl guanosine
  modified_base 13: mod_base = OTHER; note = 2'-O-methoxyethyl 5-methylcytidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with cytosine base
  misc_feature 1..20: note = RNA
gcagaggtgaagcgaagtgc

SEQ ID NO: 334 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-fluoro 2'-deoxyadenosine
  modified_base 17: mod_base = OTHER; note = 2'fluoro 2'-deoxy guanosine
  modified_base 18: mod_base = OTHER; note = 2'-fluoro 2'-deoxyuridine
  modified_base 19: mod_base = OTHER; note = 2'fluoro 2'-deoxy guanosine
  modified_base 20: mod_base = OTHER; note = 2'fluoro 2'-deoxy cytidine
  misc_feature 1..5: note = RNA
  misc_feature 6..15: note = DNA
  misc_feature 16..20: note = RNA
gcagaggtgaagcgaagtgc

SEQ ID NO: 335 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-fluoro 2'-deoxyadenosine
  modified_base 17: mod_base = OTHER; note = 2'fluoro 2'-deoxy guanosine
  modified_base 18: mod_base = OTHER; note = 2'-fluoro 2'-deoxyuridine
  modified_base 19: mod_base = OTHER; note = 2'fluoro 2'-deoxy guanosine
  modified_base 20: mod_base = OTHER; note = 2'fluoro 2'-deoxy cytidine
  misc_feature 1..5: note = RNA
  misc_feature 6..15: note = DNA
  misc_feature 16..20: note = RNA
gcagaggtgaagcgaagtgc

SEQ ID NO: 336 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 337 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 338 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 339 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 340 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 341 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 342 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 343 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 5: mod_base = OTHER; note = 2'-O-methoxyethyl adenosine
  modified_base 6: mod_base = OTHER; note = 2'-O-methyl guanosine
  modified_base 11: mod_base = OTHER; note = 2'-O-methyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3: note = RNA
  misc_feature 4: note = DNA
  misc_feature 5..6: note = RNA
  misc_feature 7..10: note = DNA
  misc_feature 11: note = RNA
  misc_feature 12..15: note = DNA
  misc_feature 16..20: note = RNA
gcagaggtgaagcgaagtgc

SEQ ID NO: 344 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 345 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 346 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 347 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 348 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..16: note = DNA
  misc_feature 17..20: note = RNA
gcagaggtgaagcgaagtgc

SEQ ID NO: 349 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 350 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 351 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 352 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 353 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 354 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 355 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 356 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 357 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..18: note = DNA
  misc_feature 19..20: note = RNA
gcagaggtgaagcgaagtgc

SEQ ID NO: 358 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..18: note = DNA
  misc_feature 19..20: note = RNA
gcagaggtgaagcgaagtgc

SEQ ID NO: 359 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 360 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 361 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 362 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 363 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..18: note = DNA
  misc_feature 19..20: note = RNA
gcagaggtgaagcgaagtgc

SEQ ID NO: 364 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 365 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 366 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 367 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 368 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 369 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 370 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 371 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = Locked nucleic acid with 5-methylcytidine base
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 372 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 373 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 374 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 375 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..18: note = DNA
  misc_feature 19..20: note = RNA
gcagaggtgaagcgaagtgc

SEQ ID NO: 376 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 377 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 378 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 379 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 18: mod_base = OTHER; note = 2'-O-methoxyethyl uridine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..17: note = DNA
  misc_feature 18..20: note = RNA
gcagaggtgaagcgaagtgc

SEQ ID NO: 380 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = Locked nucleic acid with guanine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..18: note = DNA
  misc_feature 19..20: note = RNA
gcagaggtgaagcgaagtgc

SEQ ID NO: 381 - DNA, 16 bp, synthetic construct
  source 1..16: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 8: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 14: mod_base = OTHER; note = 2'-O-methoxyethyl thymidine
  modified_base 15: mod_base = OTHER; note = 2'-O-methoxyethyl 5-methylcytidine
  modified_base 16: mod_base = OTHER; note = 2'-O-methoxyethyl 5-methylcytidine
  misc_feature 1..3: note = RNA
  misc_feature 4..13: note = DNA
  misc_feature 14..16: note = RNA
gtctgtgcatctctcc

SEQ ID NO: 382 - DNA, 16 bp, synthetic construct
  source 1..16: mol_type = other DNA
  modified_base 1: mod_base = OTHER; note = Locked nucleic acid with guanine base
  modified_base 2: mod_base = OTHER; note = Locked nucleic acid with thymine base
  modified_base 3: mod_base = OTHER; note = Locked nucleic acid with 5-methylcytidine base
  modified_base 8: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 14: mod_base = OTHER; note = Locked nucleic acid with thymine base
  modified_base 15: mod_base = OTHER; note = Locked nucleic acid with 5-methylcytidine base
  modified_base 16: mod_base = OTHER; note = Locked nucleic acid with 5-methylcytidine base
  misc_feature 1..3: note = RNA
  misc_feature 4..13: note = DNA
  misc_feature 14..16: note = RNA
gtctgtgcatctctcc

SEQ ID NO: 383 - DNA, 18 bp, synthetic construct
  source 1..18: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 4: mod_base = OTHER; note = 2'-deoxy 5-methylcytidine
  modified_base 8: mod_base = OTHER; note = 2'-deoxy 5-methylcytidine
  modified_base 10: mod_base = OTHER; note = 2'-deoxy 5-methylcytidine
  modified_base 16: mod_base = OTHER; note = 2'-deoxy 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  misc_feature 1..2: note = RNA
  misc_feature 3..16: note = DNA
  misc_feature 17..18: note = RNA
gctcatactcgtaggcca

SEQ ID NO: 384 - DNA, 18 bp, synthetic construct
  source 1..18: mol_type = other DNA
  modified_base 1: mod_base = OTHER; note = Locked nucleic acid with guanine base
  modified_base 2: mod_base = OTHER; note = Locked nucleic acid with 5-methylcytidine base
  modified_base 4: mod_base = OTHER; note = 2'-deoxy 5-methylcytidine
  modified_base 8: mod_base = OTHER; note = 2'-deoxy 5-methylcytidine
  modified_base 10: mod_base = OTHER; note = 2'-deoxy 5-methylcytidine
  modified_base 16: mod_base = OTHER; note = 2'-deoxy 5-methylcytidine
  modified_base 17: mod_base = OTHER; note = Locked nucleic acid with 5-methylcytidine base
  modified_base 18: mod_base = OTHER; note = Locked nucleic acid with adenine base
  misc_feature 1..2: note = RNA
  misc_feature 3..16: note = DNA
  misc_feature 17..18: note = RNA
gctcatactcgtaggcca

SEQ ID NO: 385 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 386 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 387 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 388 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 389 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 390 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 391 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 392 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 393 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 394 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 395 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 396 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..16: note = DNA
  misc_feature 17..20: note = RNA
gcagaggtgaagcgaagtgc

SEQ ID NO: 397 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 398 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 399 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 400 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 10: mod_base = OTHER; note = 2'-O-methyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 401 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 402 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 403 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 404 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 405 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 406 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 407 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-deoxy 5-methylcytidine
  modified_base 3: mod_base = OTHER; note = Locked nucleic acid with adenine base
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 408 - DNA, 20 bp, synthetic construct
  source 1..20: mol_type = other DNA
  modified_base 1: mod_base = OTHER; note = Locked nucleic acid with guanine base
  modified_base 2: mod_base = OTHER; note = 2'-O-methoxyethyl 5-methylcytidine
  modified_base 3: mod_base = OTHER; note = Locked nucleic acid with adenine base
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4..9: note = DNA
  misc_feature 10: note = RNA
  misc_feature 11..15: note = DNA
  misc_feature 16..20: note = RNA
gcagaggtgaagcgaagtgc

SEQ ID NO: 409 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 410 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..14: note = DNA
  misc_feature 15..20: note = RNA
gcagaggtgaagcgaagtgc

SEQ ID NO: 411 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 412 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4: note = DNA
  misc_feature 5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 413 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..2: note = RNA
  misc_feature 3: note = DNA
  misc_feature 4..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 414 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 415 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 416 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 417 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methyl adenosine
  modified_base 13: mod_base = OTHER; note = 2'-deoxy 5-methylcytidine
  modified_base 15: mod_base = OTHER; note = 2'-O-methyl adenosine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 418 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..16: note = DNA
  misc_feature 17..20: note = RNA
gcagaggtgaagcgaagtgc

SEQ ID NO: 419 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..16: note = DNA
  misc_feature 17..20: note = RNA
gcagaggtgaagcgaagtgc

SEQ ID NO: 420 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4..9: note = DNA
  misc_feature 10: note = RNA
  misc_feature 11..16: note = DNA
  misc_feature 17..20: note = RNA
gcagaggtgaagcgaagtgc

SEQ ID NO: 421 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 422 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 423 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 424 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 425 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 426 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 427 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 428 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 429 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 430 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 431 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 432 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 433 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 434 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = Locked nucleic acid with guanine base
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 435 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 436 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..2: note = RNA
  misc_feature 3: note = DNA
  misc_feature 4..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 437 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 438 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 439 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 440 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1: note = RNA
  misc_feature 2: note = DNA
  misc_feature 3..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 441 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2..3: note = DNA
  misc_feature 4..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 442 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..2: note = RNA
  misc_feature 3..4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 443 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 444 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..15: note = DNA
  misc_feature 16..20: note = RNA
gcagaggtgaagcgaagtgc

SEQ ID NO: 445 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..15: note = DNA
  misc_feature 16..20: note = RNA
gcagaggtgaagcgaagtgc

SEQ ID NO: 446 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..15: note = DNA
  misc_feature 16..20: note = RNA
gcagaggtgaagcgaagtgc

SEQ ID NO: 447 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 448 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 449 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..2: note = RNA
  misc_feature 3: note = DNA
  misc_feature 4..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 450 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 451 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..14: note = DNA
  misc_feature 15..20: note = RNA
gcagaggtgaagcgaagtgc

SEQ ID NO: 452 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..14: note = DNA
  misc_feature 15..20: note = RNA
gcagaggtgaagcgaagtgc

SEQ ID NO: 453 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 454 - DNA, 16 bp, synthetic construct
  source 1..16: mol_type = other DNA
  modified_base 1: mod_base = OTHER; note = Locked nucleic acid with guanine base
  modified_base 2: mod_base = OTHER; note = Locked nucleic acid with thymine base
  modified_base 3: mod_base = OTHER; note = Locked nucleic acid with cytosine base
  modified_base 8: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 14: mod_base = OTHER; note = Locked nucleic acid with thymine base
  modified_base 15: mod_base = OTHER; note = Locked nucleic acid with cytosine base
  modified_base 16: mod_base = OTHER; note = Locked nucleic acid with cytosine base
  misc_feature 1..3: note = RNA
  misc_feature 4..13: note = DNA
  misc_feature 14..16: note = RNA
gtctgtgcatctctcc

SEQ ID NO: 455 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 456 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 457 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 458 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 459 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 460 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..4: note = RNA
  misc_feature 5..9: note = DNA
  misc_feature 10: note = RNA
  misc_feature 11..14: note = DNA
  misc_feature 15..20: note = RNA
gcagaggtgaagcgaagtgc

SEQ ID NO: 461 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 15: mod_base = OTHER; note = 2'-O-methoxyethyl adenosine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = Locked nucleic acid with thymine base
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..14: note = DNA
  misc_feature 15..20: note = RNA
gcagaggtgaagcgaagtgc

SEQ ID NO: 462 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = Locked nucleic acid with 5-methylcytidine base
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 463 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-deoxy 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = Locked nucleic acid with adenine base
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = 2'-O-methoxyethyl 5-methylcytidine
  misc_feature 1: note = RNA
  misc_feature 2: note = DNA
  misc_feature 3..5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 464 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 5: mod_base = OTHER; note = 2'-O-methoxyethyl adenosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..3: note = RNA
  misc_feature 4: note = DNA
  misc_feature 5: note = RNA
  misc_feature 6..9: note = DNA
  misc_feature 10: note = RNA
  misc_feature 11..15: note = DNA
  misc_feature 16..20: note = RNA
gcagaggtgaagcgaagtgc

SEQ ID NO: 465 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 466 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl guanosine
  modified_base 6: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
agaggcaggagtgcctaagg

SEQ ID NO: 467 - DNA, 20 bp, synthetic construct
  source 1..20: mol_type = other DNA
  modified_base 1: mod_base = OTHER; note = 2'-O-methyl 5-methylcytidine
  modified_base 2: mod_base = OTHER; note = 2'-O-methyl 5-methylcytidine
  modified_base 3: mod_base = OTHER; note = 2'-O-methyl guanosine
  modified_base 4: mod_base = OTHER; note = 2'-O-methyl uridine
  modified_base 5: mod_base = OTHER; note = 2'-O-methyl guanosine
  modified_base 8: mod_base = OTHER; note = 2'-deoxy cytidine
  modified_base 10: mod_base = OTHER; note = 2'-deoxy cytidine
  modified_base 13: mod_base = OTHER; note = 2'-deoxy cytidine
  modified_base 15: mod_base = OTHER; note = 2'-deoxy cytidine
  modified_base 16: mod_base = OTHER; note = 2'-O-methyl uridine
  modified_base 17: mod_base = OTHER; note = 2'-O-methyl uridine
  modified_base 18: mod_base = OTHER; note = 2'-O-methyl 5-methylcytidine
  modified_base 19: mod_base = OTHER; note = 2'-O-methyl adenosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
ccgtgtgcacttcgcttcac

SEQ ID NO: 468 - DNA, 20 bp, synthetic construct
  source 1..20: mol_type = other DNA
  modified_base 1: mod_base = OTHER; note = 2'-O-methyl 5-methylcytidine
  modified_base 2: mod_base = OTHER; note = 2'-O-methyl uridine
  modified_base 3: mod_base = OTHER; note = 2'-O-methyl guanosine
  modified_base 4: mod_base = OTHER; note = 2'-O-methyl guanosine
  modified_base 5: mod_base = OTHER; note = 2'-O-methyl 5-methylcytidine
  modified_base 7: mod_base = OTHER; note = 2'-deoxy cytidine
  modified_base 14: mod_base = OTHER; note = 2'-deoxy cytidine
  modified_base 16: mod_base = OTHER; note = 2'-O-methyl adenosine
  modified_base 17: mod_base = OTHER; note = 2'-O-methyl guanosine
  modified_base 18: mod_base = OTHER; note = 2'-O-methyl uridine
  modified_base 19: mod_base = OTHER; note = 2'-O-methyl guanosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
ctggctcagtttactagtgc

SEQ ID NO: 469 - DNA, 19 bp, synthetic construct
  source 1..19: mol_type = other DNA
  modified_base 1: mod_base = OTHER; note = 2'-O-methyl guanosine
  modified_base 2: mod_base = OTHER; note = 2'-O-methyl 5-methylcytidine
  modified_base 3: mod_base = OTHER; note = 2'-O-methyl 5-methylcytidine
  modified_base 4: mod_base = OTHER; note = 2'-O-methyl guanosine
  modified_base 5: mod_base = OTHER; note = 2'-O-methyl adenosine
  modified_base 7: mod_base = OTHER; note = 2'-deoxy cytidine
  modified_base 8: mod_base = OTHER; note = 2'-deoxy cytidine
  modified_base 12: mod_base = OTHER; note = 2'-deoxy cytidine
  modified_base 15: mod_base = OTHER; note = 2'-O-methyl guanosine
  modified_base 16: mod_base = OTHER; note = 2'-O-methyl guanosine
  modified_base 17: mod_base = OTHER; note = 2'-O-methyl adenosine
  modified_base 18: mod_base = OTHER; note = 2'-O-methyl adenosine
  modified_base 19: mod_base = OTHER; note = 2'-O-methyl 5-methylcytidine
  misc_feature 1..5: note = RNA
  misc_feature 6..14: note = DNA
  misc_feature 15..19: note = RNA
gccgatccatactgggaac

SEQ ID NO: 470 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl uridine
  modified_base 3: mod_base = OTHER; note = 2'-O-methyl guanosine
  modified_base 4: mod_base = OTHER; note = 2'-O-methyl guanosine
  modified_base 5: mod_base = OTHER; note = 2'-O-methyl adenosine
  modified_base 6: mod_base = OTHER; note = 2'-deoxy cytidine
  modified_base 9: mod_base = OTHER; note = 2'-deoxy cytidine
  modified_base 11: mod_base = OTHER; note = 2'-deoxy cytidine
  modified_base 13: mod_base = OTHER; note = 2'-deoxy cytidine
  modified_base 16: mod_base = OTHER; note = 2'-O-methyl uridine
  modified_base 17: mod_base = OTHER; note = 2'-O-methyl uridine
  modified_base 18: mod_base = OTHER; note = 2'-O-methyl uridine
  modified_base 19: mod_base = OTHER; note = 2'-O-methyl uridine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
gtggacttctctcaattttc

SEQ ID NO: 471 - DNA, 20 bp, synthetic construct
  source 1..20: mol_type = other DNA
  modified_base 1: mod_base = OTHER; note = 2'-O-methyl 5-methylcytidine
  modified_base 2: mod_base = OTHER; note = 2'-O-methyl guanosine
  modified_base 3: mod_base = OTHER; note = 2'-O-methyl 5-methylcytidine
  modified_base 4: mod_base = OTHER; note = 2'-O-methyl uridine
  modified_base 5: mod_base = OTHER; note = 2'-O-methyl guanosine
  modified_base 10: mod_base = OTHER; note = 2'-deoxy cytidine
  modified_base 16: mod_base = OTHER; note = 2'-O-methyl uridine
  modified_base 17: mod_base = OTHER; note = 2'-O-methyl uridine
  modified_base 18: mod_base = OTHER; note = 2'-O-methyl guanosine
  modified_base 19: mod_base = OTHER; note = 2'-O-methyl guanosine
  modified_base 20: mod_base = OTHER; note = 2'-O-methyl uridine
  misc_feature 1..5: note = RNA
  misc_feature 6..15: note = DNA
  misc_feature 16..20: note = RNA
cgctgtaggcataaattggt

SEQ ID NO: 472 - DNA, 20 bp, synthetic construct
  source 1..20: mol_type = other DNA
  modified_base 1: mod_base = OTHER; note = 2'-O-methyl uridine
  modified_base 2: mod_base = OTHER; note = 2'-O-methyl guanosine
  modified_base 3: mod_base = OTHER; note = 2'-O-methyl adenosine
  modified_base 4: mod_base = OTHER; note = 2'-O-methyl 5-methylcytidine
  modified_base 5: mod_base = OTHER; note = 2'-O-methyl adenosine
  modified_base 11: mod_base = OTHER; note = 2'-deoxy cytidine
  modified_base 12: mod_base = OTHER; note = 2'-deoxy cytidine
  modified_base 14: mod_base = OTHER; note = 2'-deoxy cytidine
  modified_base 16: mod_base = OTHER; note = 2'-O-methyl 5-methylcytidine
  modified_base 17: mod_base = OTHER; note = 2'-O-methyl adenosine
  modified_base 18: mod_base = OTHER; note = 2'-O-methyl adenosine
  modified_base 19: mod_base = OTHER; note = 2'-O-methyl uridine
  modified_base 20: mod_base = OTHER; note = 2'-O-methyl adenosine
  misc_feature 1..5: note = RNA
  misc_feature 6..15: note = DNA
  misc_feature 16..20: note = RNA
tgacaagaatcctcacaata

SEQ ID NO: 473 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl adenosine
  modified_base 3: mod_base = OTHER; note = 2'-O-methyl 5-methylcytidine
  modified_base 4: mod_base = OTHER; note = 2'-O-methyl adenosine
  modified_base 5: mod_base = OTHER; note = 2'-O-methyl adenosine
  modified_base 10: mod_base = OTHER; note = 2'-deoxy cytidine
  modified_base 11: mod_base = OTHER; note = 2'-deoxy cytidine
  modified_base 13: mod_base = OTHER; note = 2'-deoxy cytidine
  modified_base 15: mod_base = OTHER; note = 2'-deoxy cytidine
  modified_base 16: mod_base = OTHER; note = 2'-O-methyl adenosine
  modified_base 17: mod_base = OTHER; note = 2'-O-methyl adenosine
  modified_base 18: mod_base = OTHER; note = 2'-O-methyl uridine
  modified_base 19: mod_base = OTHER; note = 2'-O-methyl adenosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
gacaagaatcctcacaatac

SEQ ID NO: 474 - DNA, 16 bp, synthetic construct
  source 1..16: mol_type = other DNA
  modified_base 1: mod_base = OTHER; note = 2'-O-methyl adenosine
  modified_base 2: mod_base = OTHER; note = 2'-O-methyl guanosine
  modified_base 3: mod_base = OTHER; note = 2'-O-methyl 5-methylcytidine
  modified_base 10: mod_base = OTHER; note = 2'-deoxy cytidine
  modified_base 12: mod_base = OTHER; note = 2'-deoxy cytidine
  modified_base 14: mod_base = OTHER; note = 2'-O-methyl 5-methylcytidine
  modified_base 15: mod_base = OTHER; note = 2'-O-methyl guanosine
  modified_base 16: mod_base = OTHER; note = 2'-O-methyl guanosine
  misc_feature 1..3: note = RNA
  misc_feature 4..13: note = DNA
  misc_feature 14..16: note = RNA
agcgaagtgcacacgg

SEQ ID NO: 475 - DNA, 20 bp, synthetic construct
  source 1..20: mol_type = other DNA
  modified_base 1: mod_base = OTHER; note = 2'-O-methyl uridine
  modified_base 2: mod_base = OTHER; note = 2'-O-methyl uridine
  modified_base 3: mod_base = OTHER; note = 2'-O-methyl 5-methylcytidine
  modified_base 4: mod_base = OTHER; note = 2'-O-methyl uridine
  modified_base 5: mod_base = OTHER; note = 2'-O-methyl uridine
  modified_base 6: mod_base = OTHER; note = 2'-deoxy cytidine
  modified_base 9: mod_base = OTHER; note = 2'-deoxy cytidine
  modified_base 16: mod_base = OTHER; note = 2'-O-methyl adenosine
  modified_base 17: mod_base = OTHER; note = 2'-O-methyl 5-methylcytidine
  modified_base 18: mod_base = OTHER; note = 2'-O-methyl 5-methylcytidine
  modified_base 19: mod_base = OTHER; note = 2'-O-methyl uridine
  modified_base 20: mod_base = OTHER; note = 2'-O-methyl guanosine
  misc_feature 1..5: note = RNA
  misc_feature 6..15: note = DNA
  misc_feature 16..20: note = RNA
ttcttcttctaggggacctg

SEQ ID NO: 476 - DNA, 20 bp, synthetic construct
  source 1..20: mol_type = other DNA
  modified_base 1: mod_base = OTHER; note = 2'-O-methyl adenosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl adenosine
  modified_base 5: mod_base = OTHER; note = 2'-O-methyl adenosine
  modified_base 6: mod_base = OTHER; note = 2'-deoxy cytidine
  modified_base 10: mod_base = OTHER; note = 2'-deoxy cytidine
  modified_base 13: mod_base = OTHER; note = 2'-deoxy cytidine
  modified_base 16: mod_base = OTHER; note = 2'-O-methyl adenosine
  modified_base 17: mod_base = OTHER; note = 2'-O-methyl 5-methylcytidine
  modified_base 18: mod_base = OTHER; note = 2'-O-methyl 5-methylcytidine
  modified_base 19: mod_base = OTHER; note = 2'-O-methyl uridine
  modified_base 20: mod_base = OTHER; note = 2'-O-methyl uridine
  misc_feature 1..5: note = RNA
  misc_feature 6..15: note = DNA
  misc_feature 16..20: note = RNA
acaaacgggcaacatacctt

SEQ ID NO: 477 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl guanosine
  modified_base 3: mod_base = OTHER; note = 2'-O-methyl adenosine
  modified_base 4: mod_base = OTHER; note = 2'-O-methyl uridine
  modified_base 5: mod_base = OTHER; note = 2'-O-methyl uridine
  modified_base 6: mod_base = OTHER; note = 2'-deoxy cytidine
  modified_base 9: mod_base = OTHER; note = 2'-deoxy cytidine
  modified_base 11: mod_base = OTHER; note = 2'-deoxy cytidine
  modified_base 12: mod_base = OTHER; note = 2'-deoxy cytidine
  modified_base 15: mod_base = OTHER; note = 2'-deoxy cytidine
  modified_base 16: mod_base = OTHER; note = 2'-O-methyl guanosine
  modified_base 17: mod_base = OTHER; note = 2'-O-methyl guanosine
  modified_base 18: mod_base = OTHER; note = 2'-O-methyl guanosine
  modified_base 19: mod_base = OTHER; note = 2'-O-methyl adenosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
ggattcagcgccgacgggac

SEQ ID NO: 478 - DNA, 19 bp, synthetic construct
  source 1..19: mol_type = other DNA
  modified_base 1: mod_base = OTHER; note = 2'-O-methyl 5-methylcytidine
  modified_base 2: mod_base = OTHER; note = 2'-O-methyl guanosine
  modified_base 3: mod_base = OTHER; note = 2'-O-methyl uridine
  modified_base 4: mod_base = OTHER; note = 2'-O-methyl guanosine
  modified_base 5: mod_base = OTHER; note = 2'-O-methyl guanosine
  modified_base 10: mod_base = OTHER; note = 2'-deoxy cytidine
  modified_base 13: mod_base = OTHER; note = 2'-deoxy cytidine
  modified_base 15: mod_base = OTHER; note = 2'-O-methyl 5-methylcytidine
  modified_base 16: mod_base = OTHER; note = 2'-O-methyl uridine
  modified_base 17: mod_base = OTHER; note = 2'-O-methyl 5-methylcytidine
  modified_base 18: mod_base = OTHER; note = 2'-O-methyl adenosine
  modified_base 19: mod_base = OTHER; note = 2'-O-methyl adenosine
  misc_feature 1..5: note = RNA
  misc_feature 6..14: note = DNA
  misc_feature 15..19: note = RNA
cgtggtggacttctctcaa

SEQ ID NO: 479 - DNA, 20 bp, synthetic construct
  source 1..20: mol_type = other DNA
  modified_base 1: mod_base = OTHER; note = 2'-O-methyl 5-methylcytidine
  modified_base 2: mod_base = OTHER; note = 2'-O-methyl 5-methylcytidine
  modified_base 3: mod_base = OTHER; note = 2'-O-methyl uridine
  modified_base 4: mod_base = OTHER; note = 2'-O-methyl uridine
  modified_base 5: mod_base = OTHER; note = 2'-O-methyl 5-methylcytidine
  modified_base 6: mod_base = OTHER; note = 2'-deoxy cytidine
  modified_base 7: mod_base = OTHER; note = 2'-deoxy cytidine
  modified_base 16: mod_base = OTHER; note = 2'-O-methyl 5-methylcytidine
  modified_base 17: mod_base = OTHER; note = 2'-O-methyl 5-methylcytidine
  modified_base 18: mod_base = OTHER; note = 2'-O-methyl uridine
  modified_base 19: mod_base = OTHER; note = 2'-O-methyl 5-methylcytidine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
ccttccctgaaggttcctcc

SEQ ID NO: 480 - DNA, 19 bp, synthetic construct
  source 1..19: mol_type = other DNA
  modified_base 1: mod_base = OTHER; note = 2'-O-methyl 5-methylcytidine
  modified_base 2: mod_base = OTHER; note = 2'-O-methyl adenosine
  modified_base 3: mod_base = OTHER; note = 2'-O-methyl 5-methylcytidine
  modified_base 4: mod_base = OTHER; note = 2'-O-methyl thymidine
  modified_base 5: mod_base = OTHER; note = 2'-O-methyl adenosine
  modified_base 11: mod_base = OTHER; note = 2'-deoxy cytidine
  modified_base 15: mod_base = OTHER; note = 2'-O-methyl guanosine
  modified_base 16: mod_base = OTHER; note = 2'-O-methyl 5-methylcytidine
  modified_base 17: mod_base = OTHER; note = 2'-O-methyl 5-methylcytidine
  modified_base 18: mod_base = OTHER; note = 2'-O-methyl adenosine
  modified_base 19: mod_base = OTHER; note = 2'-O-methyl guanosine
  misc_feature 1..5: note = RNA
  misc_feature 6..14: note = DNA
  misc_feature 15..19: note = RNA
cactagtaaactgagccag

SEQ ID NO: 481 - DNA, 19 bp, synthetic construct
  source 1..19: mol_type = other DNA
  modified_base 1: mod_base = OTHER; note = 2'-O-methyl thymidine
  modified_base 2: mod_base = OTHER; note = 2'-O-methyl thymidine
  modified_base 3: mod_base = OTHER; note = 2'-O-methyl 5-methylcytidine
  modified_base 4: mod_base = OTHER; note = 2'-O-methyl 5-methylcytidine
  modified_base 5: mod_base = OTHER; note = 2'-O-methyl guanosine
  modified_base 6: mod_base = OTHER; note = 2'-deoxy cytidine
  modified_base 15: mod_base = OTHER; note = 2'-O-methyl thymidine
  modified_base 16: mod_base = OTHER; note = 2'-O-methyl 5-methylcytidine
  modified_base 17: mod_base = OTHER; note = 2'-O-methyl guanosine
  modified_base 18: mod_base = OTHER; note = 2'-O-methyl guanosine
  modified_base 19: mod_base = OTHER; note = 2'-O-methyl 5-methylcytidine
  misc_feature 1..5: note = RNA
  misc_feature 6..14: note = DNA
  misc_feature 15..19: note = RNA
ttccgcagtatggatcggc

SEQ ID NO: 482 - DNA, 21 bp, synthetic construct
  source 1..21: mol_type = other DNA
  modified_base 1: mod_base = OTHER; note = 2'-O-methyl adenosine
  modified_base 2: mod_base = OTHER; note = 2'-O-methyl guanosine
  modified_base 3: mod_base = OTHER; note = 2'-O-methyl adenosine
  modified_base 4: mod_base = OTHER; note = 2'-O-methyl adenosine
  modified_base 5: mod_base = OTHER; note = 2'-O-methyl adenosine
  modified_base 17: mod_base = OTHER; note = 2'-O-methyl thymidine
  modified_base 18: mod_base = OTHER; note = 2'-O-methyl 5-methylcytidine
  modified_base 19: mod_base = OTHER; note = 2'-O-methyl 5-methylcytidine
  modified_base 20: mod_base = OTHER; note = 2'-O-methyl adenosine
  modified_base 21: mod_base = OTHER; note = 2'-O-methyl 5-methylcytidine
  misc_feature 1..5: note = RNA
  misc_feature 6..16: note = DNA
  misc_feature 17..21: note = RNA
agaaaattgagagaagtccac

SEQ ID NO: 483 - DNA, 19 bp, synthetic construct
  source 1..19: mol_type = other DNA
  modified_base 1: mod_base = OTHER; note = 2'-O-methyl adenosine
  modified_base 2: mod_base = OTHER; note = 2'-O-methyl 5-methylcytidine
  modified_base 3: mod_base = OTHER; note = 2'-O-methyl 5-methylcytidine
  modified_base 4: mod_base = OTHER; note = 2'-O-methyl adenosine
  modified_base 5: mod_base = OTHER; note = 2'-O-methyl adenosine
  modified_base 12: mod_base = OTHER; note = 2'-deoxy cytidine
  modified_base 13: mod_base = OTHER; note = 2'-deoxy cytidine
  modified_base 15: mod_base = OTHER; note = 2'-O-methyl adenosine
  modified_base 16: mod_base = OTHER; note = 2'-O-methyl 5-methylcytidine
  modified_base 17: mod_base = OTHER; note = 2'-O-methyl adenosine
  modified_base 18: mod_base = OTHER; note = 2'-O-methyl guanosine
  modified_base 19: mod_base = OTHER; note = 2'-O-methyl 5-methylcytidine
  misc_feature 1..5: note = RNA
  misc_feature 6..14: note = DNA
  misc_feature 15..19: note = RNA
accaatttatgcctacagc

SEQ ID NO: 484 - DNA, 20 bp, synthetic construct
  source 1..20: mol_type = other DNA
  modified_base 1: mod_base = OTHER; note = 2'-O-methyl thymidine
  modified_base 2: mod_base = OTHER; note = 2'-O-methyl adenosine
  modified_base 3: mod_base = OTHER; note = 2'-O-methyl thymidine
  modified_base 4: mod_base = OTHER; note = 2'-O-methyl thymidine
  modified_base 5: mod_base = OTHER; note = 2'-O-methyl guanosine
  modified_base 14: mod_base = OTHER; note = 2'-deoxy cytidine
  modified_base 16: mod_base = OTHER; note = 2'-O-methyl thymidine
  modified_base 17: mod_base = OTHER; note = 2'-O-methyl guanosine
  modified_base 18: mod_base = OTHER; note = 2'-O-methyl thymidine
  modified_base 19: mod_base = OTHER; note = 2'-O-methyl 5-methylcytidine
  modified_base 20: mod_base = OTHER; note = 2'-O-methyl adenosine
  misc_feature 1..5: note = RNA
  misc_feature 6..15: note = DNA
  misc_feature 16..20: note = RNA
tattgtgaggattcttgtca

SEQ ID NO: 485 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl thymidine
  modified_base 3: mod_base = OTHER; note = 2'-O-methyl adenosine
  modified_base 4: mod_base = OTHER; note = 2'-O-methyl thymidine
  modified_base 5: mod_base = OTHER; note = 2'-O-methyl thymidine
  modified_base 15: mod_base = OTHER; note = 2'-deoxy cytidine
  modified_base 16: mod_base = OTHER; note = 2'-O-methyl thymidine
  modified_base 17: mod_base = OTHER; note = 2'-O-methyl thymidine
  modified_base 18: mod_base = OTHER; note = 2'-O-methyl guanosine
  modified_base 19: mod_base = OTHER; note = 2'-O-methyl thymidine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
gtattgtgaggattcttgtc

SEQ ID NO: 486 - DNA, 20 bp, synthetic construct
  source 1..20: mol_type = other DNA
  modified_base 1: mod_base = OTHER; note = 2'-O-methyl 5-methylcytidine
  modified_base 2: mod_base = OTHER; note = 2'-O-methyl 5-methylcytidine
  modified_base 3: mod_base = OTHER; note = 2'-O-methyl thymidine
  modified_base 4: mod_base = OTHER; note = 2'-O-methyl thymidine
  modified_base 5: mod_base = OTHER; note = 2'-O-methyl 5-methylcytidine
  modified_base 6: mod_base = OTHER; note = 2'-deoxy cytidine
  modified_base 7: mod_base = OTHER; note = 2'-deoxy cytidine
  modified_base 16: mod_base = OTHER; note = 2'-O-methyl 5-methylcytidine
  modified_base 17: mod_base = OTHER; note = 2'-O-methyl 5-methylcytidine
  modified_base 18: mod_base = OTHER; note = 2'-O-methyl thymidine
  modified_base 19: mod_base = OTHER; note = 2'-O-methyl 5-methylcytidine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
ccttccctgaaggttcctcc

SEQ ID NO: 487 - DNA, 20 bp, synthetic construct
  source 1..20: mol_type = other DNA
  modified_base 1: mod_base = OTHER; note = 2'-O-methyl thymidine
  modified_base 2: mod_base = OTHER; note = 2'-O-methyl thymidine
  modified_base 3: mod_base = OTHER; note = 2'-O-methyl 5-methylcytidine
  modified_base 4: mod_base = OTHER; note = 2'-O-methyl thymidine
  modified_base 5: mod_base = OTHER; note = 2'-O-methyl thymidine
  modified_base 6: mod_base = OTHER; note = 2'-deoxy cytidine
  modified_base 9: mod_base = OTHER; note = 2'-deoxy cytidine
  modified_base 16: mod_base = OTHER; note = 2'-O-methyl adenosine
  modified_base 17: mod_base = OTHER; note = 2'-O-methyl 5-methylcytidine
  modified_base 18: mod_base = OTHER; note = 2'-O-methyl 5-methylcytidine
  modified_base 19: mod_base = OTHER; note = 2'-O-methyl thymidine
  modified_base 20: mod_base = OTHER; note = 2'-O-methyl guanosine
  misc_feature 1..5: note = RNA
  misc_feature 6..15: note = DNA
  misc_feature 16..20: note = RNA
ttcttcttctaggggacctg

SEQ ID NO: 488 - DNA, 20 bp, synthetic construct
  source 1..20: mol_type = other DNA
  modified_base 1: mod_base = OTHER; note = 2'-O-methyl adenosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl adenosine
  modified_base 5: mod_base = OTHER; note = 2'-O-methyl adenosine
  modified_base 6: mod_base = OTHER; note = 2'-deoxy cytidine
  modified_base 10: mod_base = OTHER; note = 2'-deoxy cytidine
  modified_base 13: mod_base = OTHER; note = 2'-deoxy cytidine
  modified_base 16: mod_base = OTHER; note = 2'-O-methyl adenosine
  modified_base 17: mod_base = OTHER; note = 2'-O-methyl 5-methylcytidine
  modified_base 18: mod_base = OTHER; note = 2'-O-methyl 5-methylcytidine
  modified_base 19: mod_base = OTHER; note = 2'-O-methyl thymidine
  modified_base 20: mod_base = OTHER; note = 2'-O-methyl thymidine
  misc_feature 1..5: note = RNA
  misc_feature 6..15: note = DNA
  misc_feature 16..20: note = RNA
acaaacgggcaacatacctt

SEQ ID NO: 489 - DNA, 20 bp, synthetic construct
  source 1..20: mol_type = other DNA
  modified_base 1: mod_base = OTHER; note = 2'-O-methyl guanosine
  modified_base 2: mod_base = OTHER; note = 2'-O-methyl guanosine
  modified_base 3: mod_base = OTHER; note = 2'-O-methyl adenosine
  modified_base 4: mod_base = OTHER; note = 2'-O-methyl thymidine
  modified_base 5: mod_base = OTHER; note = 2'-O-methyl thymidine
  modified_base 6: mod_base = OTHER; note = 2'-deoxy cytidine
  modified_base 9: mod_base = OTHER; note = 2'-deoxy cytidine
  modified_base 11: mod_base = OTHER; note = 2'-deoxy cytidine
  modified_base 12: mod_base = OTHER; note = 2'-deoxy cytidine
  modified_base 15: mod_base = OTHER; note = 2'-deoxy cytidine
  modified_base 16: mod_base = OTHER; note = 2'-O-methyl guanosine
  modified_base 17: mod_base = OTHER; note = 2'-O-methyl guanosine
  modified_base 18: mod_base = OTHER; note = 2'-O-methyl guanosine
  modified_base 19: mod_base = OTHER; note = 2'-O-methyl adenosine
  modified_base 20: mod_base = OTHER; note = 2'-O-methyl 5-methylcytidine
  misc_feature 1..5: note = RNA
  misc_feature 6..15: note = DNA
  misc_feature 16..20: note = RNA
ggattcagcgccgacgggac

SEQ ID NO: 490 - DNA, 20 bp, synthetic construct
  source 1..20: mol_type = other DNA
  modified_base 1: mod_base = OTHER; note = 2'-O-methyl adenosine
  modified_base 2: mod_base = OTHER; note = 2'-O-methyl thymidine
  modified_base 3: mod_base = OTHER; note = 2'-O-methyl thymidine
  modified_base 4: mod_base = OTHER; note = 2'-O-methyl guanosine
  modified_base 5: mod_base = OTHER; note = 2'-O-methyl adenosine
  modified_base 13: mod_base = OTHER; note = 2'-deoxy cytidine
  modified_base 14: mod_base = OTHER; note = 2'-deoxy cytidine
  modified_base 16: mod_base = OTHER; note = 2'-O-methyl 5-methylcytidine
  modified_base 17: mod_base = OTHER; note = 2'-O-methyl 5-methylcytidine
  modified_base 18: mod_base = OTHER; note = 2'-O-methyl adenosine
  modified_base 19: mod_base = OTHER; note = 2'-O-methyl 5-methylcytidine
  modified_base 20: mod_base = OTHER; note = 2'-O-methyl guanosine
  misc_feature 1..5: note = RNA
  misc_feature 6..15: note = DNA
  misc_feature 16..20: note = RNA
attgagagaagtccaccacg

SEQ ID NO: 491 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
agaaaattgagagaagtcca

SEQ ID NO: 492 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gaaaattgagagaagtccac

SEQ ID NO: 493 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl thymidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
aaaattgagagaagtccacc

SEQ ID NO: 494 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl thymidine
  modified_base 5: mod_base = OTHER; note = 2'-O-methoxyethyl thymidine
  modified_base 15: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
aaattgagagaagtccacca

SEQ ID NO: 495 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl guanosine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
aattgagagaagtccaccac

SEQ ID NO: 496 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl thymidine
  modified_base 3: mod_base = OTHER; note = 2'-O-methoxyethyl thymidine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
attgagagaagtccaccacg

SEQ ID NO: 497 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl guanosine
  modified_base 12: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
cagaggtgaagcgaagtgca

SEQ ID NO: 498 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl guanosine
  modified_base 11: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
agaggtgaagcgaagtgcac

SEQ ID NO: 499 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl thymidine
  modified_base 10: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gaggtgaagcgaagtgcaca

SEQ ID NO: 500 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl guanosine
  modified_base 9: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
aggtgaagcgaagtgcacac

SEQ ID NO: 501 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
ggtgaagcgaagtgcacacg

SEQ ID NO: 502 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtgaagcgaagtgcacacgg

SEQ ID NO: 503 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl thymidine
  modified_base 12: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcactagtaaactgagccag

SEQ ID NO: 504 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 7: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gttccgcagtatggatcggc

SEQ ID NO: 505 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl adenosine
  modified_base 12: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
accaatttatgcctacagcc

SEQ ID NO: 506 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl adenosine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
tattgtgaggattcttgtca

SEQ ID NO: 507 - DNA, 30 bp, synthetic construct
  source 1..30: mol_type = other DNA
  modified_base 1: mod_base = OTHER; note = 2'-O-methoxyethyl thymidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl guanosine
  modified_base 19: mod_base = OTHER; note = 2'-deoxy 5-methylcytidine
  modified_base 24: mod_base = OTHER; note = 2'-deoxy 5-methylcytidine
  modified_base 26: mod_base = OTHER; note = 2'-O-methoxyethyl adenosine
  modified_base 27: mod_base = OTHER; note = 2'-O-methoxyethyl 5-methylcytidine
  modified_base 28: mod_base = OTHER; note = 2'-O-methoxyethyl adenosine
  modified_base 29: mod_base = OTHER; note = 2'-O-methoxyethyl adenosine
  modified_base 30: mod_base = OTHER; note = 2'-O-methoxyethyl guanosine
  misc_feature 1..5: note = RNA
  misc_feature 6..25: note = DNA
  misc_feature 26..30: note = RNA
tgcggtattgtgaggattcttgtcaacaag

SEQ ID NO: 508 - DNA, 16 bp, synthetic construct
  source 1..16: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 10: mod_base = OTHER; note = 2'-deoxy 5-methylcytidine
  modified_base 12: mod_base = OTHER; note = 2'-deoxy 5-methylcytidine
  modified_base 14: mod_base = OTHER; note = 2'-O-methoxyethyl 5-methylcytidine
  modified_base 15: mod_base = OTHER; note = 2'-O-methoxyethyl guanosine
  modified_base 16: mod_base = OTHER; note = 2'-O-methoxyethyl guanosine
  misc_feature 1..3: note = RNA
  misc_feature 4..13: note = DNA
  misc_feature 14..16: note = RNA
agcgaagtgcacacgg

SEQ ID NO: 509 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl 5-methylcytidine
  modified_base 6: mod_base = OTHER; note = 2'-deoxy 5-methylcytidine
  modified_base 7: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ccttccctgaaggttcctcc

SEQ ID NO: 510 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl thymidine
  modified_base 5: mod_base = OTHER; note = 2'-O-methoxyethyl thymidine
  modified_base 6: mod_base = OTHER; note = 2'-deoxy 5-methylcytidine
  modified_base 9: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl thymidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
ttcttcttctaggggacctg

SEQ ID NO: 511 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 6: mod_base = OTHER; note = 2'-deoxy 5-methylcytidine
  modified_base 10: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl thymidine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
acaaacgggcaacatacctt

SEQ ID NO: 512 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gtgaagcgaagtgcaccaac

SEQ ID NO: 513 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
caacagcgaagtgcacacgg

SEQ ID NO: 514 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl thymidine
  modified_base 19: mod_base = OTHER; note = 2'-O-methoxyethyl thymidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ctgcggtattgtgaggattc

SEQ ID NO: 515 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl thymidine
  modified_base 16: mod_base = OTHER; note = 2'-O-methoxyethyl thymidine
  modified_base 17: mod_base = OTHER; note = 2'-O-methoxyethyl thymidine
  modified_base 18: mod_base = OTHER; note = 2'-O-methoxyethyl 5-methylcytidine
  modified_base 19: mod_base = OTHER; note = 2'-O-methoxyethyl thymidine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
gcggtattgtgaggattctt

SEQ ID NO: 516 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl adenosine
  modified_base 5: mod_base = OTHER; note = 2'-O-methoxyethyl thymidine
  modified_base 16: mod_base = OTHER; note = 2'-O-methoxyethyl 5-methylcytidine
  modified_base 17: mod_base = OTHER; note = 2'-O-methoxyethyl thymidine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
ggtattgtgaggattcttgt

SEQ ID NO: 517 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl adenosine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
tattgtgaggattcttgtca

SEQ ID NO: 518 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl guanosine
  modified_base 12: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ttgtgaggattcttgtcaac

SEQ ID NO: 519 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl guanosine
  modified_base 10: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gtgaggattcttgtcaacaa

SEQ ID NO: 520 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gaggattcttgtcaacaaga

SEQ ID NO: 521 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl thymidine
  modified_base 5: mod_base = OTHER; note = 2'-O-methoxyethyl guanosine
  modified_base 7: mod_base = OTHER; note = 2'-deoxy 5-methylcytidine
  modified_base 9: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
aaatggcactagtaaactga

SEQ ID NO: 522 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 7: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
atggcactagtaaactgagc

SEQ ID NO: 523 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ggcactagtaaactgagcca

SEQ ID NO: 524 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl thymidine
  modified_base 5: mod_base = OTHER; note = 2'-O-methoxyethyl adenosine
  modified_base 11: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cactagtaaactgagccagg

SEQ ID NO: 525 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl thymidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl thymidine
  modified_base 9: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
ctagtaaactgagccaggag

SEQ ID NO: 526 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 12: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
agtaaactgagccaggagaa

SEQ ID NO: 527 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-deoxy 5-methylcytidine
  modified_base 10: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl thymidine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
taggagttccgcagtatgga

SEQ ID NO: 528 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl thymidine
  modified_base 7: mod_base = OTHER; note = 2'-deoxy 5-methylcytidine
  modified_base 8: mod_base = OTHER; note = 2'-deoxy 5-methylcytidine
  modified_base 10: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl thymidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggagttccgcagtatggatc

SEQ ID NO: 529 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl 5-methylcytidine
  modified_base 6: mod_base = OTHER; note = 2'-deoxy 5-methylcytidine
  modified_base 8: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl thymidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
agttccgcagtatggatcgg

SEQ ID NO: 530 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ttccgcagtatggatcggca

SEQ ID NO: 531 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ccgcagtatggatcggcaga

SEQ ID NO: 532 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl thymidine
  modified_base 12: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcagtatggatcggcagagg

SEQ ID NO: 533 - DNA, 30 bp, synthetic construct
  source 1..30: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl uridine
  modified_base 5: mod_base = OTHER; note = 2'-O-methoxyethyl guanosine
  modified_base 7: mod_base = OTHER; note = 2'-deoxy 5-methylcytidine
  modified_base 9: mod_base = OTHER; note = 2'-deoxy 5-methylcytidine
  modified_base 17: mod_base = OTHER; note = 2'-deoxy 5-methylcytidine
  modified_base 22: mod_base = OTHER; note = 2'-deoxy 5-methylcytidine
  modified_base 23: mod_base = OTHER; note = 2'-deoxy 5-methylcytidine
  modified_base 26: mod_base = OTHER; note = 2'-O-methoxyethyl guanosine
  modified_base 27: mod_base = OTHER; note = 2'-O-methoxyethyl adenosine
  modified_base 28: mod_base = OTHER; note = 2'-O-methoxyethyl guanosine
  modified_base 29: mod_base = OTHER; note = 2'-O-methoxyethyl adenosine
  modified_base 30: mod_base = OTHER; note = 2'-O-methoxyethyl adenosine
  misc_feature 1..5: note = RNA
  misc_feature 6..25: note = DNA
  misc_feature 26..30: note = RNA
aaatggcactagtaaactgagccaggagaa

SEQ ID NO: 534 - DNA, 30 bp, synthetic construct
  source 1..30: mol_type = other DNA
  modified_base 1: mod_base = OTHER; note = 2'-O-methoxyethyl uridine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl adenosine
  modified_base 9: mod_base = OTHER; note = 2'-deoxy 5-methylcytidine
  modified_base 10: mod_base = OTHER; note = 2'-deoxy 5-methylcytidine
  modified_base 12: mod_base = OTHER; note = 2'-deoxy 5-methylcytidine
  modified_base 22: mod_base = OTHER; note = 2'-deoxy 5-methylcytidine
  modified_base 25: mod_base = OTHER; note = 2'-deoxy 5-methylcytidine
  modified_base 26: mod_base = OTHER; note = 2'-O-methoxyethyl adenosine
  modified_base 27: mod_base = OTHER; note = 2'-O-methoxyethyl guanosine
  modified_base 28: mod_base = OTHER; note = 2'-O-methoxyethyl adenosine
  modified_base 29: mod_base = OTHER; note = 2'-O-methoxyethyl guanosine
  modified_base 30: mod_base = OTHER; note = 2'-O-methoxyethyl guanosine
  misc_feature 1..5: note = RNA
  misc_feature 6..25: note = DNA
  misc_feature 26..30: note = RNA
taggagttccgcagtatggatcggcagagg

SEQ ID NO: 535 - DNA, 30 bp, synthetic construct
  source 1..30: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 7: mod_base = OTHER; note = 2'-deoxy 5-methylcytidine
  modified_base 8: mod_base = OTHER; note = 2'-deoxy 5-methylcytidine
  modified_base 17: mod_base = OTHER; note = 2'-deoxy 5-methylcytidine
  modified_base 18: mod_base = OTHER; note = 2'-deoxy 5-methylcytidine
  modified_base 21: mod_base = OTHER; note = 2'-deoxy 5-methylcytidine
  modified_base 24: mod_base = OTHER; note = 2'-deoxy 5-methylcytidine
  modified_base 25: mod_base = OTHER; note = 2'-deoxy 5-methylcytidine
  modified_base 26: mod_base = OTHER; note = 2'-O-methoxyethyl uridine
  modified_base 27: mod_base = OTHER; note = 2'-O-methoxyethyl 5-methylcytidine
  modified_base 28: mod_base = OTHER; note = 2'-O-methoxyethyl 5-methylcytidine
  modified_base 29: mod_base = OTHER; note = 2'-O-methoxyethyl uridine
  modified_base 30: mod_base = OTHER; note = 2'-O-methoxyethyl adenosine
  misc_feature 1..5: note = RNA
  misc_feature 6..25: note = DNA
  misc_feature 26..30: note = RNA
cgcagaccaatttatgcctacagcctccta

SEQ ID NO: 536 - DNA, 30 bp, synthetic construct
  source 1..30: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl guanosine
  modified_base 7: mod_base = OTHER; note = 2'-deoxy 5-methylcytidine
  modified_base 11: mod_base = OTHER; note = 2'-deoxy 5-methylcytidine
  modified_base 15: mod_base = OTHER; note = 2'-deoxy 5-methylcytidine
  modified_base 18: mod_base = OTHER; note = 2'-deoxy 5-methylcytidine
  modified_base 22: mod_base = OTHER; note = 2'-deoxy 5-methylcytidine
  modified_base 23: mod_base = OTHER; note = 2'-deoxy 5-methylcytidine
  modified_base 26: mod_base = OTHER; note = 2'-O-methoxyethyl guanosine
  modified_base 27: mod_base = OTHER; note = 2'-O-methoxyethyl adenosine
  modified_base 28: mod_base = OTHER; note = 2'-O-methoxyethyl uridine
  modified_base 29: mod_base = OTHER; note = 2'-O-methoxyethyl adenosine
  modified_base 30: mod_base = OTHER; note = 2'-O-methoxyethyl guanosine
  misc_feature 1..5: note = RNA
  misc_feature 6..25: note = DNA
  misc_feature 26..30: note = RNA
agaggacaaacgggcaacataccttgatag

SEQ ID NO: 537 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl uridine
  modified_base 5: mod_base = OTHER; note = 2'-O-methoxyethyl uridine
  modified_base 6: mod_base = OTHER; note = 2'-deoxy 5-methylcytidine
  modified_base 9: mod_base = OTHER; note = 2'-deoxy 5-methylcytidine
  modified_base 11: mod_base = OTHER; note = 2'-deoxy 5-methylcytidine
  modified_base 12: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggattcagcgccgacgggac

SEQ ID NO: 538 - DNA, 30 bp, synthetic construct
  source 1..30: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 11: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-deoxy 5-methylcytidine
  modified_base 17: mod_base = OTHER; note = 2'-deoxy 5-methylcytidine
  modified_base 20: mod_base = OTHER; note = 2'-deoxy 5-methylcytidine
  modified_base 25: mod_base = OTHER; note = 2'-deoxy 5-methylcytidine
  modified_base 26: mod_base = OTHER; note = 2'-O-methoxyethyl guanosine
  modified_base 27: mod_base = OTHER; note = 2'-O-methoxyethyl uridine
  modified_base 28: mod_base = OTHER; note = 2'-O-methoxyethyl adenosine
  modified_base 29: mod_base = OTHER; note = 2'-O-methoxyethyl adenosine
  modified_base 30: mod_base = OTHER; note = 2'-O-methoxyethyl adenosine
  misc_feature 1..5: note = RNA
  misc_feature 6..25: note = DNA
  misc_feature 26..30: note = RNA
ccgcaggattcagcgccgacgggacgtaaa

SEQ ID NO: 539 - DNA, 25 bp, synthetic construct
  source 1..25: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl thymidine
  modified_base 21: mod_base = OTHER; note = 2'-O-methoxyethyl guanosine
  modified_base 22: mod_base = OTHER; note = 2'-O-methoxyethyl thymidine
  modified_base 23: mod_base = OTHER; note = 2'-O-methoxyethyl 5-methylcytidine
  modified_base 24: mod_base = OTHER; note = 2'-O-methoxyethyl 5-methylcytidine
  modified_base 25: mod_base = OTHER; note = 2'-O-methoxyethyl adenosine
  misc_feature 1..5: note = RNA
  misc_feature 6..20: note = DNA
  misc_feature 21..25: note = RNA
cccctagaaaattgagagaagtcca

SEQ ID NO: 540 - DNA, 30 bp, synthetic construct
  source 1..30: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl thymidine
  modified_base 23: mod_base = OTHER; note = 2'-deoxy 5-methylcytidine
  modified_base 24: mod_base = OTHER; note = 2'-deoxy 5-methylcytidine
  modified_base 26: mod_base = OTHER; note = 2'-O-methoxyethyl 5-methylcytidine
  modified_base 27: mod_base = OTHER; note = 2'-O-methoxyethyl 5-methylcytidine
  modified_base 28: mod_base = OTHER; note = 2'-O-methoxyethyl adenosine
  modified_base 29: mod_base = OTHER; note = 2'-O-methoxyethyl 5-methylcytidine
  modified_base 30: mod_base = OTHER; note = 2'-O-methoxyethyl guanosine
  misc_feature 1..5: note = RNA
  misc_feature 6..25: note = DNA
  misc_feature 26..30: note = RNA
cccctagaaaattgagagaagtccaccacg

SEQ ID NO: 541 - DNA, 25 bp, synthetic construct
  source 1..25: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 18: mod_base = OTHER; note = 2'-deoxy 5-methylcytidine
  modified_base 19: mod_base = OTHER; note = 2'-deoxy 5-methylcytidine
  modified_base 21: mod_base = OTHER; note = 2'-O-methoxyethyl 5-methylcytidine
  modified_base 22: mod_base = OTHER; note = 2'-O-methoxyethyl 5-methylcytidine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl guanosine
  misc_feature 1..5: note = RNA
  misc_feature 6..20: note = DNA
  misc_feature 21..25: note = RNA
agaaaattgagagaagtccaccacg

SEQ ID NO: 542 - DNA, 30 bp, synthetic construct
  source 1..30: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 18: mod_base = OTHER; note = 2'-deoxy 5-methylcytidine
  modified_base 19: mod_base = OTHER; note = 2'-deoxy 5-methylcytidine
  modified_base 21: mod_base = OTHER; note = 2'-deoxy 5-methylcytidine
  modified_base 22: mod_base = OTHER; note = 2'-deoxy 5-methylcytidine
  modified_base 24: mod_base = OTHER; note = 2'-deoxy 5-methylcytidine
  modified_base 26: mod_base = OTHER; note = 2'-O-methoxyethyl adenosine
  modified_base 27: mod_base = OTHER; note = 2'-O-methoxyethyl guanosine
  modified_base 28: mod_base = OTHER; note = 2'-O-methoxyethyl thymidine
  modified_base 29: mod_base = OTHER; note = 2'-O-methoxyethyl 5-methylcytidine
  modified_base 30: mod_base = OTHER; note = 2'-O-methoxyethyl thymidine
  misc_feature 1..5: note = RNA
  misc_feature 6..25: note = DNA
  misc_feature 26..30: note = RNA
agaaaattgagagaagtccaccacgagtct

SEQ ID NO: 543 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl guanosine
  modified_base 6: mod_base = OTHER; note = 2'-deoxy 5-methylcytidine
  modified_base 13: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
tgaagcgaagtgcacacggt

SEQ ID NO: 544 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 12: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gaagcgaagtgcacacggtc

SEQ ID NO: 545 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 11: mod_base = OTHER; note = 2'-deoxy 5-methylcytidine
  modified_base 13: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
aagcgaagtgcacacggtcc

SEQ ID NO: 546 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl adenosine
  modified_base 10: mod_base = OTHER; note = 2'-deoxy 5-methylcytidine
  modified_base 12: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
agcgaagtgcacacggtccg

SEQ ID NO: 547 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcgaagtgcacacggtccgg

SEQ ID NO: 548 - DNA, 26 bp, synthetic construct
  source 1..26: mol_type = other DNA
  modified_base 1: mod_base = OTHER; note = 2'-O-methoxyethyl adenosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 6: mod_base = OTHER; note = 2'-O-methoxyethyl adenosine
  modified_base 7: mod_base = OTHER; note = 2'-O-methoxyethyl 5-methylcytidine
  modified_base 8: mod_base = OTHER; note = 2'-O-methoxyethyl thymidine
  modified_base 15: mod_base = OTHER; note = 2'-deoxy 5-methylcytidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl 5-methylcytidine
  modified_base 22: mod_base = OTHER; note = 2'-O-methoxyethyl adenosine
  modified_base 23: mod_base = OTHER; note = 2'-O-methoxyethyl guanosine
  modified_base 24: mod_base = OTHER; note = 2'-O-methoxyethyl guanosine
  modified_base 25: mod_base = OTHER; note = 2'-O-methoxyethyl adenosine
  modified_base 26: mod_base = OTHER; note = 2'-O-methoxyethyl guanosine
  misc_feature 1..8: note = RNA
  misc_feature 9..18: note = DNA
  misc_feature 19..26: note = RNA
atggcactagtaaactgagccaggag

SEQ ID NO: 549 - DNA, 24 bp, synthetic construct
  source 1..24: mol_type = other DNA
  modified_base 1: mod_base = OTHER; note = 2'-O-methoxyethyl thymidine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-O-methoxyethyl 5-methylcytidine
  modified_base 7: mod_base = OTHER; note = 2'-O-methoxyethyl thymidine
  modified_base 14: mod_base = OTHER; note = 2'-deoxy 5-methylcytidine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl guanosine
  modified_base 23: mod_base = OTHER; note = 2'-O-methoxyethyl guanosine
  modified_base 24: mod_base = OTHER; note = 2'-O-methoxyethyl adenosine
  misc_feature 1..7: note = RNA
  misc_feature 8..17: note = DNA
  misc_feature 18..24: note = RNA
tggcactagtaaactgagccagga

SEQ ID NO: 550 - DNA, 22 bp, synthetic construct
  source 1..22: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 6: mod_base = OTHER; note = 2'-O-methoxyethyl thymidine
  modified_base 13: mod_base = OTHER; note = 2'-deoxy 5-methylcytidine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl adenosine
  modified_base 21: mod_base = OTHER; note = 2'-O-methoxyethyl guanosine
  modified_base 22: mod_base = OTHER; note = 2'-O-methoxyethyl guanosine
  misc_feature 1..6: note = RNA
  misc_feature 7..16: note = DNA
  misc_feature 17..22: note = RNA
ggcactagtaaactgagccagg

SEQ ID NO: 551 - DNA, 18 bp, synthetic construct
  source 1..18: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl thymidine
  modified_base 11: mod_base = OTHER; note = 2'-deoxy 5-methylcytidine
  modified_base 15: mod_base = OTHER; note = 2'-O-methoxyethyl guanosine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  misc_feature 1..4: note = RNA
  misc_feature 5..14: note = DNA
  misc_feature 15..18: note = RNA
cactagtaaactgagcca

SEQ ID NO: 552 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl thymidine
  modified_base 6: mod_base = OTHER; note = 2'-O-methoxyethyl adenosine
  modified_base 7: mod_base = OTHER; note = 2'-O-methoxyethyl guanosine
  modified_base 8: mod_base = OTHER; note = 2'-O-methoxyethyl thymidine
  modified_base 9: mod_base = OTHER; note = 2'-O-methoxyethyl adenosine
  modified_base 10: mod_base = OTHER; note = 2'-O-methoxyethyl adenosine
  modified_base 11: mod_base = OTHER; note = 2'-O-methoxyethyl adenosine
  modified_base 12: mod_base = OTHER; note = 2'-O-methoxyethyl 5-methylcytidine
  modified_base 13: mod_base = OTHER; note = 2'-O-methoxyethyl thymidine
  modified_base 14: mod_base = OTHER; note = 2'-O-methoxyethyl guanosine
  modified_base 15: mod_base = OTHER; note = 2'-O-methoxyethyl adenosine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  misc_feature 1..20: note = RNA
gcactagtaaactgagccag

SEQ ID NO: 553 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl thymidine
  modified_base 6: mod_base = OTHER; note = 2'-deoxy 5-methylcytidine
  modified_base 9: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
agactctgcggtattgtgag

SEQ ID NO: 554 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl thymidine
  modified_base 5: mod_base = OTHER; note = 2'-O-methoxyethyl 5-methylcytidine
  modified_base 8: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gactctgcggtattgtgagg

SEQ ID NO: 555 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl thymidine
  modified_base 7: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
actctgcggtattgtgagga

SEQ ID NO: 556 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl thymidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
ctctgcggtattgtgaggat

SEQ ID NO: 557 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl thymidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl thymidine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
tctgcggtattgtgaggatt

SEQ ID NO: 558 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl thymidine
  modified_base 19: mod_base = OTHER; note = 2'-O-methoxyethyl thymidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ctgcggtattgtgaggattc

SEQ ID NO: 559 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl guanosine
  modified_base 16: mod_base = OTHER; note = 2'-O-methoxyethyl adenosine
  modified_base 17: mod_base = OTHER; note = 2'-O-methoxyethyl thymidine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
tgcggtattgtgaggattct

SEQ ID NO: 560 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl thymidine
  modified_base 16: mod_base = OTHER; note = 2'-O-methoxyethyl thymidine
  modified_base 17: mod_base = OTHER; note = 2'-O-methoxyethyl thymidine
  modified_base 18: mod_base = OTHER; note = 2'-O-methoxyethyl 5-methylcytidine
  modified_base 19: mod_base = OTHER; note = 2'-O-methoxyethyl thymidine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
gcggtattgtgaggattctt

SEQ ID NO: 561 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl adenosine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl thymidine
  modified_base 19: mod_base = OTHER; note = 2'-O-methoxyethyl thymidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cggtattgtgaggattcttg

SEQ ID NO: 562 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ggcactagtaaactgagcca

SEQ ID NO: 563 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl thymidine
  modified_base 12: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcactagtaaactgagccag

SEQ ID NO: 564 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl thymidine
  modified_base 5: mod_base = OTHER; note = 2'-O-methoxyethyl adenosine
  modified_base 11: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cactagtaaactgagccagg

SEQ ID NO: 565 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl thymidine
  modified_base 4: mod_base = OTHER; note = 2'-O-methoxyethyl adenosine
  modified_base 5: mod_base = OTHER; note = 2'-O-methoxyethyl guanosine
  modified_base 10: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
actagtaaactgagccagga

SEQ ID NO: 566 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ttccgcagtatggatcggca

SEQ ID NO: 567 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
tccgcagtatggatcggcag

SEQ ID NO: 568 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ccgcagtatggatcggcaga

SEQ ID NO: 569 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 13: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cgcagtatggatcggcagag

SEQ ID NO: 570 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl guanosine
  modified_base 8: mod_base = OTHER; note = 2'-deoxy 5-methylcytidine
  modified_base 10: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
cgaagtgcacacggtccggc

SEQ ID NO: 571 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl thymidine
  modified_base 7: mod_base = OTHER; note = 2'-deoxy 5-methylcytidine
  modified_base 9: mod_base = OTHER; note = 2'-deoxy 5-methylcytidine
  modified_base 11: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gaagtgcacacggtccggca

SEQ ID NO: 572 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl guanosine
  modified_base 6: mod_base = OTHER; note = 2'-deoxy 5-methylcytidine
  modified_base 8: mod_base = OTHER; note = 2'-deoxy 5-methylcytidine
  modified_base 10: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
aagtgcacacggtccggcag

SEQ ID NO: 573 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-deoxy 5-methylcytidine
  modified_base 8: mod_base = OTHER; note = 2'-deoxy 5-methylcytidine
  modified_base 12: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
gtgcacacggtccggcagat

SEQ ID NO: 574 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-deoxy 5-methylcytidine
  modified_base 10: mod_base = OTHER; note = 2'-deoxy 5-methylcytidine
  modified_base 11: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gcacacggtccggcagatga

SEQ ID NO: 575 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 8: mod_base = OTHER; note = 2'-deoxy 5-methylcytidine
  modified_base 9: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
acacggtccggcagatgaga

SEQ ID NO: 576 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl thymidine
  modified_base 6: mod_base = OTHER; note = 2'-deoxy 5-methylcytidine
  modified_base 7: mod_base = OTHER; note = 2'-deoxy 5-methylcytidine
  modified_base 10: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
acggtccggcagatgagaag

SEQ ID NO: 577 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 8: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggtccggcagatgagaaggc

SEQ ID NO: 578 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
tccggcagatgagaaggcac

SEQ ID NO: 579 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cggcagatgagaaggcacag

SEQ ID NO: 580 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagatgagaaggcacagac

SEQ ID NO: 581 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl thymidine
  modified_base 5: mod_base = OTHER; note = 2'-O-methoxyethyl guanosine
  modified_base 12: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
agatgagaaggcacagacgg

SEQ ID NO: 582 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl guanosine
  modified_base 10: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
atgagaaggcacagacgggg

SEQ ID NO: 583 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 8: mod_base = OTHER; note = 2'-deoxy 5-methylcytidine
  modified_base 10: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gagaaggcacagacggggag

SEQ ID NO: 584 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl guanosine
  modified_base 6: mod_base = OTHER; note = 2'-deoxy 5-methylcytidine
  modified_base 8: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gaaggcacagacggggagtc

SEQ ID NO: 585 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-deoxy 5-methylcytidine
  modified_base 10: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
aggcacagacggggagtccg

SEQ ID NO: 586 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 8: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcacagacggggagtccgcg

SEQ ID NO: 587 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
acagacggggagtccgcgta

SEQ ID NO: 588 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 12: mod_base = OTHER; note = 2'-deoxy 5-methylcytidine
  modified_base 13: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
agacggggagtccgcgtaaa

SEQ ID NO: 589 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl guanosine
  modified_base 10: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
acggggagtccgcgtaaaga

SEQ ID NO: 590 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-deoxy 5-methylcytidine
  modified_base 9: mod_base = OTHER; note = 2'-deoxy 5-methylcytidine
  modified_base 11: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ggggagtccgcgtaaagaga

SEQ ID NO: 591 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl thymidine
  modified_base 6: mod_base = OTHER; note = 2'-deoxy 5-methylcytidine
  modified_base 7: mod_base = OTHER; note = 2'-deoxy 5-methylcytidine
  modified_base 9: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
ggagtccgcgtaaagagagg

SEQ ID NO: 592 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 7: mod_base = OTHER; note = 2'-deoxy 5-methylcytidine
  modified_base 8: mod_base = OTHER; note = 2'-deoxy 5-methylcytidine
  modified_base 10: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggtcgtccgcaggattcagc

SEQ ID NO: 593 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl thymidine
  modified_base 6: mod_base = OTHER; note = 2'-deoxy 5-methylcytidine
  modified_base 7: mod_base = OTHER; note = 2'-deoxy 5-methylcytidine
  modified_base 9: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtcgtccgcaggattcagcg

SEQ ID NO: 594 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl 5-methylcytidine
  modified_base 6: mod_base = OTHER; note = 2'-deoxy 5-methylcytidine
  modified_base 8: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
tcgtccgcaggattcagcgc

SEQ ID NO: 595 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
cgtccgcaggattcagcgcc

SEQ ID NO: 596 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtccgcaggattcagcgccg

SEQ ID NO: 597 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 12: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
tccgcaggattcagcgccga

SEQ ID NO: 598 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 11: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ccgcaggattcagcgccgac

SEQ ID NO: 599 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 10: mod_base = OTHER; note = 2'-deoxy 5-methylcytidine
  modified_base 13: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cgcaggattcagcgccgacg

SEQ ID NO: 600 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl guanosine
  modified_base 9: mod_base = OTHER; note = 2'-deoxy 5-methylcytidine
  modified_base 12: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcaggattcagcgccgacgg

SEQ ID NO: 601 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl adenosine
  modified_base 8: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
caggattcagcgccgacggg

SEQ ID NO: 602 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl thymidine
  modified_base 7: mod_base = OTHER; note = 2'-deoxy 5-methylcytidine
  modified_base 10: mod_base = OTHER; note = 2'-deoxy 5-methylcytidine
  modified_base 12: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
aggattcagcgccgacggga

SEQ ID NO: 603 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl 5-methylcytidine
  modified_base 8: mod_base = OTHER; note = 2'-deoxy 5-methylcytidine
  modified_base 10: mod_base = OTHER; note = 2'-deoxy 5-methylcytidine
  modified_base 11: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gattcagcgccgacgggacg

SEQ ID NO: 604 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl thymidine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl adenosine
  modified_base 7: mod_base = OTHER; note = 2'-deoxy 5-methylcytidine
  modified_base 9: mod_base = OTHER; note = 2'-deoxy 5-methylcytidine
  modified_base 10: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
attcagcgccgacgggacgt

SEQ ID NO: 605 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 6: mod_base = OTHER; note = 2'-deoxy 5-methylcytidine
  modified_base 8: mod_base = OTHER; note = 2'-deoxy 5-methylcytidine
  modified_base 9: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ttcagcgccgacgggacgta

SEQ ID NO: 606 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 7: mod_base = OTHER; note = 2'-deoxy 5-methylcytidine
  modified_base 8: mod_base = OTHER; note = 2'-deoxy 5-methylcytidine
  modified_base 11: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
tcagcgccgacgggacgtaa

SEQ ID NO: 607 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 7: mod_base = OTHER; note = 2'-deoxy 5-methylcytidine
  modified_base 10: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
cagcgccgacgggacgtaaa

SEQ ID NO: 608 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 6: mod_base = OTHER; note = 2'-deoxy 5-methylcytidine
  modified_base 9: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
agcgccgacgggacgtaaac

SEQ ID NO: 609 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 8: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gcgccgacgggacgtaaaca

SEQ ID NO: 610 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 7: mod_base = OTHER; note = 2'-deoxy 5-methylcytidine
  modified_base 12: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
cgccgacgggacgtaaacaa

SEQ ID NO: 611 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl adenosine
  modified_base 6: mod_base = OTHER; note = 2'-deoxy 5-methylcytidine
  modified_base 11: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gccgacgggacgtaaacaaa

SEQ ID NO: 612 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl 5-methylcytidine
  modified_base 10: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl adenosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
ccgacgggacgtaaacaaag

SEQ ID NO: 613 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 9: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cgacgggacgtaaacaaagg

SEQ ID NO: 614 - DNA, 40 bp, synthetic construct
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA
gcgaagtgcacacggtccggaacacaacacaacacaacac

SEQ ID NO: 615 - DNA, 40 bp, synthetic construct
  source 1..40: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 6: mod_base = OTHER; note = 2'-O-methoxyethyl adenosine
  modified_base 7: mod_base = OTHER; note = 2'-O-methoxyethyl adenosine
  modified_base 8: mod_base = OTHER; note = 2'-O-methoxyethyl 5-methylcytidine
  modified_base 9: mod_base = OTHER; note = 2'-O-methoxyethyl adenosine
  modified_base 10: mod_base = OTHER; note = 2'-O-methoxyethyl 5-methylcytidine
  modified_base 11: mod_base = OTHER; note = 2'-O-methoxyethyl guanosine
  modified_base 12: mod_base = OTHER; note = 2'-O-methoxyethyl 5-methylcytidine
  modified_base 13: mod_base = OTHER; note = 2'-O-methoxyethyl guanosine
  modified_base 14: mod_base = OTHER; note = 2'-O-methoxyethyl adenosine
  modified_base 15: mod_base = OTHER; note = 2'-O-methoxyethyl adenosine
  modified_base 19: mod_base = OTHER; note = 2'-deoxy 5-methylcytidine
  modified_base 21: mod_base = OTHER; note = 2'-deoxy 5-methylcytidine
  modified_base 23: mod_base = OTHER; note = 2'-deoxy 5-methylcytidine
  modified_base 26: mod_base = OTHER; note = 2'-O-methoxyethyl thymidine
  modified_base 27: mod_base = OTHER; note = 2'-O-methoxyethyl 5-methylcytidine
  modified_base 28: mod_base = OTHER; note = 2'-O-methoxyethyl 5-methylcytidine
  modified_base 29: mod_base = OTHER; note = 2'-O-methoxyethyl guanosine
  modified_base 30: mod_base = OTHER; note = 2'-O-methoxyethyl guanosine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..15: note = RNA
  misc_feature 16..25: note = DNA
  misc_feature 26..40: note = RNA
aacacaacacgcgaagtgcacacggtccggaacacaacac

SEQ ID NO: 616 - DNA, 40 bp, synthetic construct
  source 1..40: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 6: mod_base = OTHER; note = 2'-O-methoxyethyl adenosine
  modified_base 7: mod_base = OTHER; note = 2'-O-methoxyethyl adenosine
  modified_base 8: mod_base = OTHER; note = 2'-O-methoxyethyl 5-methylcytidine
  modified_base 9: mod_base = OTHER; note = 2'-O-methoxyethyl adenosine
  modified_base 10: mod_base = OTHER; note = 2'-O-methoxyethyl 5-methylcytidine
  modified_base 11: mod_base = OTHER; note = 2'-O-methoxyethyl adenosine
  modified_base 12: mod_base = OTHER; note = 2'-O-methoxyethyl adenosine
  modified_base 13: mod_base = OTHER; note = 2'-O-methoxyethyl 5-methylcytidine
  modified_base 14: mod_base = OTHER; note = 2'-O-methoxyethyl adenosine
  modified_base 15: mod_base = OTHER; note = 2'-O-methoxyethyl 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  modified_base 21: mod_base = OTHER; note = 2'-O-methoxyethyl guanosine
  modified_base 22: mod_base = OTHER; note = 2'-O-methoxyethyl 5-methylcytidine
  modified_base 23: mod_base = OTHER; note = 2'-O-methoxyethyl guanosine
  modified_base 24: mod_base = OTHER; note = 2'-O-methoxyethyl adenosine
  modified_base 25: mod_base = OTHER; note = 2'-O-methoxyethyl adenosine
  modified_base 29: mod_base = OTHER; note = 2'-deoxy 5-methylcytidine
  modified_base 31: mod_base = OTHER; note = 2'-deoxy 5-methylcytidine
  modified_base 33: mod_base = OTHER; note = 2'-deoxy 5-methylcytidine
  modified_base 36: mod_base = OTHER; note = 2'-O-methoxyethyl thymidine
  modified_base 37: mod_base = OTHER; note = 2'-O-methoxyethyl 5-methylcytidine
  modified_base 38: mod_base = OTHER; note = 2'-O-methoxyethyl 5-methylcytidine
  modified_base 39: mod_base = OTHER; note = 2'-O-methoxyethyl guanosine
  modified_base 40: mod_base = OTHER; note = 2'-O-methoxyethyl guanosine
  misc_feature 1..25: note = RNA
  misc_feature 26..35: note = DNA
  misc_feature 36..40: note = RNA
aacacaacacaacacaacacgcgaagtgcacacggtccgg

SEQ ID NO: 617 - DNA, 40 bp, synthetic construct
  source 1..40: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl thymidine
  modified_base 5: mod_base = OTHER; note = 2'-O-methoxyethyl adenosine
  modified_base 11: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA
cactagtaaactgagccaggaacacaacacaacacaacac

SEQ ID NO: 618 - DNA, 40 bp, synthetic construct
  source 1..40: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 15: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl guanosine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA
tccgcagtatggatcggcagaacacaacacaacacaacac

SEQ ID NO: 619 - DNA, 40 bp, synthetic construct
  source 1..40: mol_type = other DNA
  modified_base 1: mod_base = OTHER; note = 2'-O-methoxyethyl 5-methylcytidine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl thymidine
  modified_base 19: mod_base = OTHER; note = 2'-O-methoxyethyl thymidine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl 5-methylcytidine
  modified_base 26: mod_base = OTHER; note = 2'-O-methoxyethyl adenosine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl adenosine
  modified_base 33: mod_base = OTHER; note = 2'-O-methoxyethyl 5-methylcytidine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine
  misc_feature 1..5: note = RNA
  misc_feature 6..15: note = DNA
  misc_feature 16..40: note = RNA
ctgcggtattgtgaggattcaacacaacacaacacaacac

SEQ ID NO: 620 - DNA, 40 bp, synthetic construct
  source 1..40: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl adenosine
  modified_base 23: mod_base = OTHER; note = 2'-O-methoxyethyl 5-methylcytidine
  modified_base 24: mod_base = OTHER; note = 2'-O-methoxyethyl adenosine
  modified_base 25: mod_base = OTHER; note = 2'-O-methoxyethyl adenosine
  modified_base 26: mod_base = OTHER; note = 2'-O-methoxyethyl 5-methylcytidine
  modified_base 27: mod_base = OTHER; note = 2'-O-methoxyethyl adenosine
  modified_base 28: mod_base = OTHER; note = 2'-O-methoxyethyl adenosine
  modified_base 29: mod_base = OTHER; note = 2'-O-methoxyethyl 5-methylcytidine
  modified_base 30: mod_base = OTHER; note = 2'-O-methoxyethyl adenosine
  modified_base 31: mod_base = OTHER; note = 2'-O-methoxyethyl adenosine
  modified_base 32: mod_base = OTHER; note = 2'-O-methoxyethyl 5-methylcytidine
  modified_base 33: mod_base = OTHER; note = 2'-O-methoxyethyl adenosine
  modified_base 34: mod_base = OTHER; note = 2'-O-methoxyethyl adenosine
  modified_base 35: mod_base = OTHER; note = 2'-O-methoxyethyl 5-methylcytidine
  modified_base 36: mod_base = OTHER; note = 2'-O-methoxyethyl adenosine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl adenosine
  misc_feature 1..5: note = RNA
  misc_feature 6..15: note = DNA
  misc_feature 16..40: note = RNA
gcagaggtgaagcgaagtgcaacaacaacaacaacaacaa

SEQ ID NO: 621 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcgaagtgcacacggaccgg

SEQ ID NO: 622 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl guanosine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl 5-methylcytidine
  modified_base 6: mod_base = OTHER; note = 2'-deoxy 5-methylcytidine
  modified_base 9: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
cggtccggcagatgagaagg

SEQ ID NO: 623 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 7: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
gtccggcagatgagaaggca

SEQ ID NO: 624 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ccggcagatgagaaggcaca

SEQ ID NO: 625 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 15: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl guanosine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ggcagatgagaaggcacaga

SEQ ID NO: 626 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 7: mod_base = OTHER; note = 2'-deoxy 5-methylcytidine
  modified_base 11: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
aaggcacagacggggagtcc

SEQ ID NO: 627 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl 5-methylcytidine
  modified_base 9: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggcacagacggggagtccgc

SEQ ID NO: 628 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl adenosine
  modified_base 3: mod_base = OTHER; note = 2'-O-methoxyethyl 5-methylcytidine
  modified_base 4: mod_base = OTHER; note = 2'-O-methoxyethyl adenosine
  modified_base 5: mod_base = OTHER; note = 2'-O-methoxyethyl guanosine
  modified_base 7: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
cacagacggggagtccgcgt

SEQ ID NO: 629 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl adenosine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl 5-methylcytidine
  modified_base 6: mod_base = OTHER; note = 2'-deoxy 5-methylcytidine
  modified_base 8: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl thymidine
  misc_feature 1..5: note = RNA
  misc_feature 6..15: note = DNA
  misc_feature 16..20: note = RNA
gagtccgcgtaaagagaggt

SEQ ID NO: 630 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 7: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
agtccgcgtaaagagaggtg

SEQ ID NO: 631 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gtccgcgtaaagagaggtgc

SEQ ID NO: 632 - DNA, 20 bp, synthetic construct
  source 1..20: mol_type = other DNA
  modified_base 1: mod_base = OTHER; note = 2'-O-methoxyethyl thymidine
  modified_base 2: mod_base = OTHER; note = 2'-O-methoxyethyl 5-methylcytidine
  modified_base 3: mod_base = OTHER; note = 2'-O-methoxyethyl 5-methylcytidine
  modified_base 4: mod_base = OTHER; note = 2'-O-methoxyethyl guanosine
  modified_base 5: mod_base = OTHER; note = 2'-O-methoxyethyl 5-methylcytidine
  modified_base 16: mod_base = OTHER; note = 2'-O-methoxyethyl guanosine
  modified_base 17: mod_base = OTHER; note = 2'-O-methoxyethyl thymidine
  modified_base 18: mod_base = OTHER; note = 2'-O-methoxyethyl guanosine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
tccgcgtaaagagaggtgcg

SEQ ID NO: 633 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl 5-methylcytidine
  modified_base 5: mod_base = OTHER; note = 2'-O-methoxyethyl guanosine
  modified_base 16: mod_base = OTHER; note = 2'-O-methoxyethyl thymidine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ccgcgtaaagagaggtgcgc

SEQ ID NO: 634 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl thymidine
  modified_base 5: mod_base = OTHER; note = 2'-O-methoxyethyl adenosine
  modified_base 16: mod_base = OTHER; note = 2'-O-methoxyethyl 5-methylcytidine
  modified_base 17: mod_base = OTHER; note = 2'-O-methoxyethyl guanosine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcgtaaagagaggtgcgccc

SEQ ID NO: 635 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl adenosine
  modified_base 4: mod_base = OTHER; note = 2'-O-methoxyethyl adenosine
  modified_base 5: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl 5-methylcytidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtaaagagaggtgcgccccg

SEQ ID NO: 636 - DNA, 20 bp, synthetic construct
  source 1..20: mol_type = other DNA
  modified_base 1: mod_base = OTHER; note = 2'-O-methoxyethyl adenosine
  modified_base 2: mod_base = OTHER; note = 2'-O-methoxyethyl adenosine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 12: mod_base = OTHER; note = 2'-deoxy 5-methylcytidine
  modified_base 14: mod_base = OTHER; note = 2'-deoxy 5-methylcytidine
  modified_base 15: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl guanosine
  modified_base 19: mod_base = OTHER; note = 2'-O-methoxyethyl thymidine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
aaagagaggtgcgccccgtg

SEQ ID NO: 637 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcgaagtgcacacggtccgg

SEQ ID NO: 638 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gtccgcgtaaagagaggtgc

SEQ ID NO: 639 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtgaagcgaagtgcacacgg

SEQ ID NO: 640 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl thymidine
  modified_base 4: mod_base = OTHER; note = 2'-O-methoxyethyl thymidine
  modified_base 5: mod_base = OTHER; note = 2'-O-methoxyethyl 5-methylcytidine
  modified_base 6: mod_base = OTHER; note = 2'-deoxy 5-methylcytidine
  modified_base 7: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl 5-methylcytidine
  modified_base 18: mod_base = OTHER; note = 2'-O-methoxyethyl thymidine
  modified_base 19: mod_base = OTHER; note = 2'-O-methoxyethyl 5-methylcytidine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ccttccctgaaggttcctcc

SEQ ID NO: 641 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl guanosine
  modified_base 3: mod_base = OTHER; note = 2'-O-methoxyethyl thymidine
  modified_base 4: mod_base = OTHER; note = 2'-O-methoxyethyl 5-methylcytidine
  modified_base 5: mod_base = OTHER; note = 2'-O-methoxyethyl 5-methylcytidine
  modified_base 8: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl adenosine
  modified_base 18: mod_base = OTHER; note = 2'-O-methoxyethyl guanosine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
ggtccggcagatgagaaggc

SEQ ID NO: 642 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gtccgcgtaaagagaggtgc

SEQ ID NO: 643 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtgaagcgaagtgcacacgg

SEQ ID NO: 644 - DNA, 22 bp, synthetic construct
  source 1..22: mol_type = other DNA
  modified_base 1: mod_base = OTHER; note = 2'-O-methoxyethyl uridine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl uridine
  modified_base 11: mod_base = OTHER; note = 2'-deoxy 5-methylcytidine
  modified_base 15: mod_base = OTHER; note = 2'-deoxy 5-methylcytidine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl uridine
  modified_base 21: mod_base = OTHER; note = 2'-O-methoxyethyl guanosine
  modified_base 22: mod_base = OTHER; note = 2'-O-methoxyethyl adenosine
  misc_feature 1..5: note = RNA
  misc_feature 6..17: note = DNA
  misc_feature 18..22: note = RNA
tgactgtgaacgttcgagatga

SEQ ID NO: 645 - DNA, 22 bp, synthetic construct
  source 1..22: mol_type = other DNA
  modified_base 1: mod_base = OTHER; note = 2'-O-methoxyethyl uridine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl cytidine
  modified_base 5: mod_base = OTHER; note = 2'-O-methoxyethyl uridine
  modified_base 11: mod_base = OTHER; note = 2'-deoxy 5-methylcytidine
  modified_base 15: mod_base = OTHER; note = 2'-deoxy 5-methylcytidine
  modified_base 18: mod_base = OTHER; note = 2'-O-methoxyethyl guanosine
  modified_base 19: mod_base = OTHER; note = 2'-O-methoxyethyl adenosine
  modified_base 20: mod_base = OTHER; note = 2'-O-methoxyethyl uridine
  modified_base 21: mod_base = OTHER; note = 2'-O-methoxyethyl guanosine
  modified_base 22: mod_base = OTHER; note = 2'-O-methoxyethyl adenosine
  misc_feature 1..5: note = RNA
  misc_feature 6..17: note = DNA
  misc_feature 18..22: note = RNA
tgactgtgaacgttcgagatga

SEQ ID NO: 646 - DNA, 22 bp, synthetic construct
  source 1..22: mol_type = other DNA
  modified_base 1: mod_base = OTHER; note = 2'-O-methyl uridine
  modified_base 2: mod_base = OTHER; note = 2'-O-methyl guanosine
  modified_base 3: mod_base = OTHER; note = 2'-O-methyl adenosine
  modified_base 4: mod_base = OTHER; note = 2'-O-methoxyethyl cytidine
  modified_base 5: mod_base = OTHER; note = 2'-O-methyl uridine
  modified_base 11: mod_base = OTHER; note = 2'-deoxy 5-methylcytidine
  modified_base 15: mod_base = OTHER; note = 2'-deoxy 5-methylcytidine
  modified_base 18: mod_base = OTHER; note = 2'-O-methyl guanosine
  modified_base 19: mod_base = OTHER; note = 2'-O-methyl adenosine
  modified_base 20: mod_base = OTHER; note = 2'-O-methyl uridine
  modified_base 21: mod_base = OTHER; note = 2'-O-methyl guanosine
  modified_base 22: mod_base = OTHER; note = 2'-O-methyl adenosine
  misc_feature 1..5: note = RNA
  misc_feature 6..17: note = DNA
  misc_feature 18..22: note = RNA
tgactgtgaacgttcgagatga

SEQ ID NO: 647 - DNA, 22 bp, synthetic construct
  source 1..22: mol_type = other DNA
  modified_base 1: mod_base = OTHER; note = 2'-O-methoxyethyl uridine
  modified_base 2: mod_base = OTHER; note = 2'-O-methoxyethyl guanosine
  modified_base 3: mod_base = OTHER; note = 2'-O-methoxyethyl adenosine
  modified_base 4: mod_base = OTHER; note = 2'-O-methoxyethyl cytidine
  modified_base 5: mod_base = OTHER; note = 2'-O-methoxyethyl uridine
  modified_base 11: mod_base = OTHER; note = 2'-deoxy 5-methylcytidine
  modified_base 15: mod_base = OTHER; note = 2'-deoxy 5-methylcytidine
  modified_base 18: mod_base = OTHER; note = Locked nucleic acid with guanine base
  modified_base 19: mod_base = OTHER; note = Locked nucleic acid with adenine base
  modified_base 20: mod_base = OTHER; note = Locked nucleic acid with thymine base
  modified_base 21: mod_base = OTHER; note = Locked nucleic acid with guanine base
  modified_base 22: mod_base = OTHER; note = Locked nucleic acid with adenine base
  misc_feature 1..5: note = RNA
  misc_feature 6..17: note = DNA
  misc_feature 18..22: note = RNA
tgactgtgaacgttcgagatga

SEQ ID NO: 648 - DNA, 22 bp, synthetic construct
  source 1..22: mol_type = other DNA
  modified_base 1: mod_base = OTHER; note = Locked nucleic acid with thymine base
  modified_base 2: mod_base = OTHER; note = Locked nucleic acid with guanine base
  modified_base 3: mod_base = OTHER; note = Locked nucleic acid with adenine base
  modified_base 4: mod_base = OTHER; note = Locked nucleic acid with cytosine base
  modified_base 5: mod_base = OTHER; note = Locked nucleic acid with thymine base
  modified_base 11: mod_base = OTHER; note = 2'-deoxy 5-methylcytidine
  modified_base 15: mod_base = OTHER; note = 2'-deoxy 5-methylcytidine
  modified_base 18: mod_base = OTHER; note = Locked nucleic acid with guanine base
  modified_base 19: mod_base = OTHER; note = Locked nucleic acid with adenine base
  modified_base 20: mod_base = OTHER; note = Locked nucleic acid with thymine base
  modified_base 21: mod_base = OTHER; note = Locked nucleic acid with guanine base
  modified_base 22: mod_base = OTHER; note = Locked nucleic acid with adenine base
  misc_feature 1..5: note = RNA
  misc_feature 6..17: note = DNA
  misc_feature 18..22: note = RNA
tgactgtgaacgttcgagatga

SEQ ID NO: 649 - DNA, 20 bp, synthetic construct
  source 1..20: mol_type = other DNA
  modified_base 1: mod_base = OTHER; note = 2'-O-methoxyethyl 5-methylcytidine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl guanosine
  modified_base 5: mod_base = OTHER; note = 2'-O-methoxyethyl 5-methylcytidine
  modified_base 16: mod_base = OTHER; note = 2'-O-methoxyethyl guanosine
  modified_base 17: mod_base = OTHER; note = 2'-O-methoxyethyl 5-methylcytidine
  modified_base 18: mod_base = OTHER; note = 2'-O-methoxyethyl adenosine
  modified_base 19: mod_base = OTHER; note = 2'-O-methoxyethyl 5-methylcytidine
  modified_base 20: mod_base = OTHER; note = 2'-O-methoxyethyl adenosine
  misc_feature 1..5: note = RNA
  misc_feature 6..15: note = DNA
  misc_feature 16..20: note = RNA
ccggcagatgagaaggcaca

SEQ ID NO: 650 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 9: mod_base = OTHER; note = 2'-deoxy 5-methylcytidine
  modified_base 11: mod_base = OTHER; note = 2'-deoxy 5-methylcytidine
  modified_base 13: mod_base = OTHER; note = 2'-deoxy 5-methylcytidine
  modified_base 16: mod_base = OTHER; note = 2'-O-methoxyethyl thymidine
  modified_base 17: mod_base = OTHER; note = 2'-O-methoxyethyl 5-methylcytidine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gcgaagtgcacacggtccgg

SEQ ID NO: 651 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl 5-methylcytidine
  modified_base 4: mod_base = OTHER; note = 2'-O-methoxyethyl 5-methylcytidine
  modified_base 5: mod_base = OTHER; note = 2'-O-methoxyethyl guanosine
  modified_base 6: mod_base = OTHER; note = 2'-deoxy 5-methylcytidine
  modified_base 16: mod_base = OTHER; note = 2'-O-methoxyethyl guanosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gtccgcgtaaagagaggtgc

SEQ ID NO: 652 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..15: note = DNA
  misc_feature 16..20: note = RNA
gtgaagcgaagtgcacacgg

SEQ ID NO: 653 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 8: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..7: note = DNA
  misc_feature 8: note = RNA
  misc_feature 9..15: note = DNA
  misc_feature 16..20: note = RNA
gtgaagcgaagtgcacacgg

SEQ ID NO: 654 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 10: mod_base = OTHER; note = 2'-O-methoxyethyl adenosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..9: note = DNA
  misc_feature 10: note = RNA
  misc_feature 11..15: note = DNA
  misc_feature 16..20: note = RNA
gtgaagcgaagtgcacacgg

SEQ ID NO: 655 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..10: note = DNA
  misc_feature 11: note = RNA
  misc_feature 12..15: note = DNA
  misc_feature 16..20: note = RNA
gtgaagcgaagtgcacacgg

SEQ ID NO: 656 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl thymidine
  modified_base 3: mod_base = OTHER; note = 2'-O-methoxyethyl guanosine
  modified_base 4: mod_base = OTHER; note = 2'-O-methoxyethyl adenosine
  modified_base 5: mod_base = OTHER; note = 2'-O-methoxyethyl adenosine
  modified_base 7: mod_base = OTHER; note = 2'-deoxy 5-methylcytidine
  modified_base 8: mod_base = OTHER; note = 2'-O-methoxyethyl guanosine
  modified_base 11: mod_base = OTHER; note = 2'-O-methoxyethyl guanosine
  modified_base 14: mod_base = OTHER; note = 2'-deoxy 5-methylcytidine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl guanosine
  modified_base 20: mod_base = OTHER; note = 2'-O-methoxyethyl guanosine
  misc_feature 1..5: note = RNA
  misc_feature 6..7: note = DNA
  misc_feature 8: note = RNA
  misc_feature 9..10: note = DNA
  misc_feature 11: note = RNA
  misc_feature 12..15: note = DNA
  misc_feature 16..20: note = RNA
gtgaagcgaagtgcacacgg

SEQ ID NO: 657 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 5: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = 2'-O-methoxyethyl guanosine
  modified_base 18: mod_base = OTHER; note = 2'-O-methoxyethyl thymidine
  modified_base 19: mod_base = OTHER; note = 2'-O-methoxyethyl guanosine
  modified_base 20: mod_base = OTHER; note = 2'-O-methoxyethyl 5-methylcytidine
  misc_feature 1..5: note = RNA
  misc_feature 6..15: note = DNA
  misc_feature 16..20: note = RNA
gcagaggtgaagcgaagtgc

SEQ ID NO: 658 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 659 - DNA, 20 bp, synthetic construct
  source 1..20: mol_type = other DNA
  modified_base 1: mod_base = OTHER; note = 2'-O-methoxyethyl guanosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl guanosine
  modified_base 10: mod_base = OTHER; note = 2'-O-methoxyethyl adenosine
  modified_base 13: mod_base = OTHER; note = 2'-deoxy 5-methylcytidine
  modified_base 16: mod_base = OTHER; note = 2'-O-methoxyethyl adenosine
  modified_base 17: mod_base = OTHER; note = Locked nucleic acid with guanine base
  modified_base 18: mod_base = OTHER; note = 2'-O-methoxyethyl thymidine
  modified_base 19: mod_base = OTHER; note = Locked nucleic acid with guanine base
  modified_base 20: mod_base = OTHER; note = Locked nucleic acid with 5-methylcytidine base
  misc_feature 1..4: note = RNA
  misc_feature 5..9: note = DNA
  misc_feature 10: note = RNA
  misc_feature 11..15: note = DNA
  misc_feature 16..20: note = RNA
gcagaggtgaagcgaagtgc

SEQ ID NO: 660 - RNA, 40 nt, synthetic construct
  source 1..40: mol_type = other RNA
  modified_base 1: mod_base = OTHER; note = 2'-O-methyl adenosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl 5-methylcytidine
  modified_base 5: mod_base = OTHER; note = 2'-O-methyl adenosine
  modified_base 6: mod_base = OTHER; note = 2'-O-methyl 5-methylcytidine
  modified_base 7: mod_base = OTHER; note = 2'-O-methyl adenosine
  modified_base 8: mod_base = OTHER; note = 2'-O-methyl 5-methylcytidine
  modified_base 9: mod_base = OTHER; note = 2'-O-methyl adenosine
  modified_base 10: mod_base = OTHER; note = 2'-O-methyl 5-methylcytidine
  modified_base 11: mod_base = OTHER; note = 2'-O-methyl adenosine
  modified_base 12: mod_base = OTHER; note = 2'-O-methyl 5-methylcytidine
  modified_base 13: mod_base = OTHER; note = 2'-O-methyl adenosine
  modified_base 14: mod_base = OTHER; note = 2'-O-methyl 5-methylcytidine
  modified_base 15: mod_base = OTHER; note = 2'-O-methyl adenosine
  modified_base 16: mod_base = OTHER; note = 2'-O-methyl 5-methylcytidine
  modified_base 17: mod_base = OTHER; note = 2'-O-methyl adenosine
  modified_base 18: mod_base = OTHER; note = 2'-O-methyl 5-methylcytidine
  modified_base 19: mod_base = OTHER; note = 2'-O-methyl adenosine
  modified_base 20: mod_base = OTHER; note = 2'-O-methyl 5-methylcytidine
  modified_base 21: mod_base = OTHER; note = 2'-O-methyl adenosine
  modified_base 22: mod_base = OTHER; note = 2'-O-methyl 5-methylcytidine
  modified_base 23: mod_base = OTHER; note = 2'-O-methyl adenosine
  modified_base 24: mod_base = OTHER; note = 2'-O-methyl 5-methylcytidine
  modified_base 25: mod_base = OTHER; note = 2'-O-methyl adenosine
  modified_base 26: mod_base = OTHER; note = 2'-O-methyl 5-methylcytidine
  modified_base 27: mod_base = OTHER; note = 2'-O-methyl adenosine
  modified_base 28: mod_base = OTHER; note = 2'-O-methyl 5-methylcytidine
  modified_base 29: mod_base = OTHER; note = 2'-O-methyl adenosine
  modified_base 30: mod_base = OTHER; note = 2'-O-methyl 5-methylcytidine
  modified_base 31: mod_base = OTHER; note = 2'-O-methyl adenosine
  modified_base 32: mod_base = OTHER; note = 2'-O-methyl 5-methylcytidine
  modified_base 33: mod_base = OTHER; note = 2'-O-methyl adenosine
  modified_base 34: mod_base = OTHER; note = 2'-O-methyl 5-methylcytidine
  modified_base 35: mod_base = OTHER; note = 2'-O-methyl adenosine
  modified_base 36: mod_base = OTHER; note = 2'-O-methyl 5-methylcytidine
  modified_base 37: mod_base = OTHER; note = 2'-O-methyl adenosine
  modified_base 38: mod_base = OTHER; note = 2'-O-methyl 5-methylcytidine
  modified_base 39: mod_base = OTHER; note = 2'-O-methyl adenosine
  modified_base 40: mod_base = OTHER; note = 2'-O-methyl 5-methylcytidine
acacacacacacacacacacacacacacacacacacacac

SEQ ID NO: 661 - RNA, 40 nt, synthetic construct; identical to SEQ ID NO: 660
  source 1..40: mol_type = other RNA
  modified_base 1: mod_base = OTHER; note = 2'-O-methyl adenosine
  modified_base 2: mod_base = OTHER; note = 2'-O-methyl 5-methylcytidine
  modified_base 3: mod_base = OTHER; note = 2'-O-methyl adenosine
  modified_base 4: mod_base = OTHER; note = 2'-O-methyl 5-methylcytidine
  modified_base 5: mod_base = OTHER; note = 2'-O-methyl adenosine
  modified_base 6: mod_base = OTHER; note = 2'-O-methyl 5-methylcytidine
  modified_base 7: mod_base = OTHER; note = 2'-O-methyl adenosine
  modified_base 8: mod_base = OTHER; note = 2'-O-methyl 5-methylcytidine
  modified_base 9: mod_base = OTHER; note = 2'-O-methyl adenosine
  modified_base 10: mod_base = OTHER; note = 2'-O-methyl 5-methylcytidine
  modified_base 11: mod_base = OTHER; note = 2'-O-methyl adenosine
  modified_base 12: mod_base = OTHER; note = 2'-O-methyl 5-methylcytidine
  modified_base 13: mod_base = OTHER; note = 2'-O-methyl adenosine
  modified_base 14: mod_base = OTHER; note = 2'-O-methyl 5-methylcytidine
  modified_base 15: mod_base = OTHER; note = 2'-O-methyl adenosine
  modified_base 16: mod_base = OTHER; note = 2'-O-methyl 5-methylcytidine
  modified_base 17: mod_base = OTHER; note = 2'-O-methyl adenosine
  modified_base 18: mod_base = OTHER; note = 2'-O-methyl 5-methylcytidine
  modified_base 19: mod_base = OTHER; note = 2'-O-methyl adenosine
  modified_base 20: mod_base = OTHER; note = 2'-O-methyl 5-methylcytidine
  modified_base 21: mod_base = OTHER; note = 2'-O-methyl adenosine
  modified_base 22: mod_base = OTHER; note = 2'-O-methyl 5-methylcytidine
  modified_base 23: mod_base = OTHER; note = 2'-O-methyl adenosine
  modified_base 24: mod_base = OTHER; note = 2'-O-methyl 5-methylcytidine
  modified_base 25: mod_base = OTHER; note = 2'-O-methyl adenosine
  modified_base 26: mod_base = OTHER; note = 2'-O-methyl 5-methylcytidine
  modified_base 27: mod_base = OTHER; note = 2'-O-methyl adenosine
  modified_base 28: mod_base = OTHER; note = 2'-O-methyl 5-methylcytidine
  modified_base 29: mod_base = OTHER; note = 2'-O-methyl adenosine
  modified_base 30: mod_base = OTHER; note = 2'-O-methyl 5-methylcytidine
  modified_base 31: mod_base = OTHER; note = 2'-O-methyl adenosine
  modified_base 32: mod_base = OTHER; note = 2'-O-methyl 5-methylcytidine
  modified_base 33: mod_base = OTHER; note = 2'-O-methyl adenosine
  modified_base 34: mod_base = OTHER; note = 2'-O-methyl 5-methylcytidine
  modified_base 35: mod_base = OTHER; note = 2'-O-methyl adenosine
  modified_base 36: mod_base = OTHER; note = 2'-O-methyl 5-methylcytidine
  modified_base 37: mod_base = OTHER; note = 2'-O-methyl adenosine
  modified_base 38: mod_base = OTHER; note = 2'-O-methyl 5-methylcytidine
  modified_base 39: mod_base = OTHER; note = 2'-O-methyl adenosine
  modified_base 40: mod_base = OTHER; note = 2'-O-methyl 5-methylcytidine

SEQ ID NO: 662 - DNA, 40 bp, synthetic construct
  source 1..40: mol_type = other DNA
  modified_base 2: mod_base = OTHER; note = 2'-deoxy cytidine
  modified_base 4: mod_base = OTHER; note = 2'-deoxy cytidine
  modified_base 6: mod_base = OTHER; note = 2'-deoxy cytidine
  modified_base 8: mod_base = OTHER; note = 2'-deoxy cytidine
  modified_base 10: mod_base = OTHER; note = 2'-deoxy cytidine
  modified_base 12: mod_base = OTHER; note = 2'-deoxy cytidine
  modified_base 14: mod_base = OTHER; note = 2'-deoxy cytidine
  modified_base 16: mod_base = OTHER; note = 2'-deoxy cytidine
  modified_base 18: mod_base = OTHER; note = 2'-deoxy cytidine
  modified_base 20: mod_base = OTHER; note = 2'-deoxy cytidine
  modified_base 22: mod_base = OTHER; note = 2'-deoxy cytidine
  modified_base 24: mod_base = OTHER; note = 2'-deoxy cytidine
  modified_base 26: mod_base = OTHER; note = 2'-deoxy cytidine
  modified_base 28: mod_base = OTHER; note = 2'-deoxy cytidine
  modified_base 30: mod_base = OTHER; note = 2'-deoxy cytidine
  modified_base 32: mod_base = OTHER; note = 2'-deoxy cytidine
  modified_base 34: mod_base = OTHER; note = 2'-deoxy cytidine
  modified_base 36: mod_base = OTHER; note = 2'-deoxy cytidine
  modified_base 38: mod_base = OTHER; note = 2'-deoxy cytidine
  modified_base 40: mod_base = OTHER; note = 2'-deoxy cytidine
acacacacacacacacacacacacacacacacacacacac

SEQ ID NO: 663 - DNA, 40 bp, synthetic construct
  source 1..40: mol_type = other DNA
  modified_base 2: mod_base = OTHER; note = 2'-deoxy 5-methylcytidine
  modified_base 13: mod_base = OTHER; note = 2'-deoxy 5-methylcytidine
  modified_base 17: mod_base = OTHER; note = 2'-deoxy 5-methylcytidine
  modified_base 19: mod_base = OTHER; note = 2'-deoxy 5-methylcytidine
  modified_base 21: mod_base = OTHER; note = 2'-deoxy 5-methylcytidine
  modified_base 23: mod_base = OTHER; note = 2'-deoxy 5-methylcytidine
  modified_base 26: mod_base = OTHER; note = 2'-deoxy 5-methylcytidine
  modified_base 37: mod_base = OTHER; note = 2'-deoxy 5-methylcytidine
gcagaggtgaagcgaacacacacagcagaggtgaagcgaa

SEQ ID NO: 664 - RNA, 40 nt, synthetic construct; identical to SEQ ID NO: 660
  source 1..40: mol_type = other RNA
  modified_base 1: mod_base = OTHER; note = 2'-O-methoxyethyl adenosine
  modified_base 2: mod_base = OTHER; note = 2'-O-methoxyethyl 5-methylcytidine
  modified_base 3: mod_base = OTHER; note = 2'-O-methoxyethyl adenosine
  modified_base 4: mod_base = OTHER; note = 2'-O-methoxyethyl 5-methylcytidine
  modified_base 5: mod_base = OTHER; note = 2'-O-methoxyethyl adenosine
  modified_base 6: mod_base = OTHER; note = 2'-O-methoxyethyl 5-methylcytidine
  modified_base 7: mod_base = OTHER; note = 2'-O-methoxyethyl adenosine
  modified_base 8: mod_base = OTHER; note = 2'-O-methoxyethyl 5-methylcytidine
  modified_base 9: mod_base = OTHER; note = 2'-O-methoxyethyl adenosine
  modified_base 10: mod_base = OTHER; note = 2'-O-methoxyethyl 5-methylcytidine
  modified_base 11: mod_base = OTHER; note = 2'-O-methoxyethyl adenosine
  modified_base 12: mod_base = OTHER; note = 2'-O-methoxyethyl 5-methylcytidine
  modified_base 13: mod_base = OTHER; note = 2'-O-methoxyethyl adenosine
  modified_base 14: mod_base = OTHER; note = 2'-O-methoxyethyl 5-methylcytidine
  modified_base 15: mod_base = OTHER; note = 2'-O-methoxyethyl adenosine
  modified_base 16: mod_base = OTHER; note = 2'-O-methoxyethyl 5-methylcytidine
  modified_base 17: mod_base = OTHER; note = 2'-O-methoxyethyl adenosine
  modified_base 18: mod_base = OTHER; note = 2'-O-methoxyethyl 5-methylcytidine
  modified_base 19: mod_base = OTHER; note = 2'-O-methoxyethyl adenosine
  modified_base 20: mod_base = OTHER; note = 2'-O-methoxyethyl 5-methylcytidine
  modified_base 21: mod_base = OTHER; note = 2'-O-methoxyethyl adenosine
  modified_base 22: mod_base = OTHER; note = 2'-O-methoxyethyl 5-methylcytidine
  modified_base 23: mod_base = OTHER; note = 2'-O-methoxyethyl adenosine
  modified_base 24: mod_base = OTHER; note = 2'-O-methoxyethyl 5-methylcytidine
  modified_base 25: mod_base = OTHER; note = 2'-O-methoxyethyl adenosine
  modified_base 26: mod_base = OTHER; note = 2'-O-methoxyethyl 5-methylcytidine
  modified_base 27: mod_base = OTHER; note = 2'-O-methoxyethyl adenosine
  modified_base 28: mod_base = OTHER; note = 2'-O-methoxyethyl 5-methylcytidine
  modified_base 29: mod_base = OTHER; note = 2'-O-methoxyethyl adenosine
  modified_base 30: mod_base = OTHER; note = 2'-O-methoxyethyl 5-methylcytidine
  modified_base 31: mod_base = OTHER; note = 2'-O-methoxyethyl adenosine
  modified_base 32: mod_base = OTHER; note = 2'-O-methoxyethyl 5-methylcytidine
  modified_base 33: mod_base = OTHER; note = 2'-O-methoxyethyl adenosine
  modified_base 34: mod_base = OTHER; note = 2'-O-methoxyethyl 5-methylcytidine
  modified_base 35: mod_base = OTHER; note = 2'-O-methoxyethyl adenosine
  modified_base 36: mod_base = OTHER; note = 2'-O-methoxyethyl 5-methylcytidine
  modified_base 37: mod_base = OTHER; note = 2'-O-methoxyethyl adenosine
  modified_base 38: mod_base = OTHER; note = 2'-O-methoxyethyl 5-methylcytidine
  modified_base 39: mod_base = OTHER; note = 2'-O-methoxyethyl adenosine
  modified_base 40: mod_base = OTHER; note = 2'-O-methoxyethyl 5-methylcytidine

SEQ ID NO: 665 - RNA, 40 nt, synthetic construct; identical to SEQ ID NO: 660
  source 1..40: mol_type = other RNA
  modified_base 1: mod_base = OTHER; note = Locked nucleic acid with adenine base
  modified_base 2: mod_base = OTHER; note = Locked nucleic acid with 5-methylcytidine base
  modified_base 3: mod_base = OTHER; note = Locked nucleic acid with adenine base
  modified_base 4: mod_base = OTHER; note = Locked nucleic acid with 5-methylcytidine base
  modified_base 5: mod_base = OTHER; note = Locked nucleic acid with adenine base
  modified_base 6: mod_base = OTHER; note = Locked nucleic acid with 5-methylcytidine base
  modified_base 7: mod_base = OTHER; note = Locked nucleic acid with adenine base
  modified_base 8: mod_base = OTHER; note = Locked nucleic acid with 5-methylcytidine base
  modified_base 9: mod_base = OTHER; note = Locked nucleic acid with adenine base
  modified_base 10: mod_base = OTHER; note = Locked nucleic acid with 5-methylcytidine base
  modified_base 11: mod_base = OTHER; note = Locked nucleic acid with adenine base
  modified_base 12: mod_base = OTHER; note = Locked nucleic acid with 5-methylcytidine base
  modified_base 13: mod_base = OTHER; note = Locked nucleic acid with adenine base
  modified_base 14: mod_base = OTHER; note = Locked nucleic acid with 5-methylcytidine base
  modified_base 15: mod_base = OTHER; note = Locked nucleic acid with adenine base
  modified_base 16: mod_base = OTHER; note = Locked nucleic acid with 5-methylcytidine base
  modified_base 17: mod_base = OTHER; note = Locked nucleic acid with adenine base
  modified_base 18: mod_base = OTHER; note = Locked nucleic acid with 5-methylcytidine base
  modified_base 19: mod_base = OTHER; note = Locked nucleic acid with adenine base
  modified_base 20: mod_base = OTHER; note = Locked nucleic acid with 5-methylcytidine base
  modified_base 21: mod_base = OTHER; note = Locked nucleic acid with adenine base
  modified_base 22: mod_base = OTHER; note = Locked nucleic acid with 5-methylcytidine base
  modified_base 23: mod_base = OTHER; note = Locked nucleic acid with adenine base
  modified_base 24: mod_base = OTHER; note = Locked nucleic acid with 5-methylcytidine base
  modified_base 25: mod_base = OTHER; note = Locked nucleic acid with adenine base
  modified_base 26: mod_base = OTHER; note = Locked nucleic acid with 5-methylcytidine base
  modified_base 27: mod_base = OTHER; note = Locked nucleic acid with adenine base
  modified_base 28: mod_base = OTHER; note = Locked nucleic acid with 5-methylcytidine base
  modified_base 29: mod_base = OTHER; note = Locked nucleic acid with adenine base
  modified_base 30: mod_base = OTHER; note = Locked nucleic acid with 5-methylcytidine base
  modified_base 31: mod_base = OTHER; note = Locked nucleic acid with adenine base
  modified_base 32: mod_base = OTHER; note = Locked nucleic acid with 5-methylcytidine base
  modified_base 33: mod_base = OTHER; note = Locked nucleic acid with adenine base
  modified_base 34: mod_base = OTHER; note = Locked nucleic acid with 5-methylcytidine base
  modified_base 35: mod_base = OTHER; note = Locked nucleic acid with adenine base
  modified_base 36: mod_base = OTHER; note = Locked nucleic acid with 5-methylcytidine base
  modified_base 37: mod_base = OTHER; note = Locked nucleic acid with adenine base
  modified_base 38: mod_base = OTHER; note = Locked nucleic acid with 5-methylcytidine base
  modified_base 39: mod_base = OTHER; note = Locked nucleic acid with adenine base
  modified_base 40: mod_base = OTHER; note = Locked nucleic acid with 5-methylcytidine base

SEQ ID NO: 666 - RNA, 40 nt, synthetic construct; identical to SEQ ID NO: 660
  source 1..40: mol_type = other RNA
  modified_base 1: mod_base = OTHER; note = 2'-O-methoxyethyl adenosine
  modified_base 2: mod_base = OTHER; note = Locked nucleic acid with 5-methylcytidine base
  modified_base 3: mod_base = OTHER; note = 2'-O-methoxyethyl adenosine
  modified_base 4: mod_base = OTHER; note = Locked nucleic acid with 5-methylcytidine base
  modified_base 5: mod_base = OTHER; note = 2'-O-methoxyethyl adenosine
  modified_base 6: mod_base = OTHER; note = Locked nucleic acid with 5-methylcytidine base
  modified_base 7: mod_base = OTHER; note = 2'-O-methoxyethyl adenosine
  modified_base 8: mod_base = OTHER; note = Locked nucleic acid with 5-methylcytidine base
  modified_base 9: mod_base = OTHER; note = 2'-O-methoxyethyl adenosine
  modified_base 10: mod_base = OTHER; note = Locked nucleic acid with 5-methylcytidine base
  modified_base 11: mod_base = OTHER; note = 2'-O-methoxyethyl adenosine
  modified_base 12: mod_base = OTHER; note = Locked nucleic acid with 5-methylcytidine base
  modified_base 13: mod_base = OTHER; note = 2'-O-methoxyethyl adenosine
  modified_base 14: mod_base = OTHER; note = Locked nucleic acid with 5-methylcytidine base
  modified_base 15: mod_base = OTHER; note = 2'-O-methoxyethyl adenosine
  modified_base 16: mod_base = OTHER; note = Locked nucleic acid with 5-methylcytidine base
  modified_base 17: mod_base = OTHER; note = 2'-O-methoxyethyl adenosine
  modified_base 18: mod_base = OTHER; note = Locked nucleic acid with 5-methylcytidine base
  modified_base 19: mod_base = OTHER; note = 2'-O-methoxyethyl adenosine
  modified_base 20: mod_base = OTHER; note = Locked nucleic acid with 5-methylcytidine base
  modified_base 21: mod_base = OTHER; note = 2'-O-methoxyethyl adenosine
  modified_base 22: mod_base = OTHER; note = Locked nucleic acid with 5-methylcytidine base
  modified_base 23: mod_base = OTHER; note = 2'-O-methoxyethyl adenosine
  modified_base 24: mod_base = OTHER; note = Locked nucleic acid with 5-methylcytidine base
  modified_base 25: mod_base = OTHER; note = 2'-O-methoxyethyl adenosine
  modified_base 26: mod_base = OTHER; note = Locked nucleic acid with 5-methylcytidine base
  modified_base 27: mod_base = OTHER; note = 2'-O-methoxyethyl adenosine
  modified_base 28: mod_base = OTHER; note = Locked nucleic acid with 5-methylcytidine base
  modified_base 29: mod_base = OTHER; note = 2'-O-methoxyethyl adenosine
  modified_base 30: mod_base = OTHER; note = Locked nucleic acid with 5-methylcytidine base
  modified_base 31: mod_base = OTHER; note = 2'-O-methoxyethyl adenosine
  modified_base 32: mod_base = OTHER; note = Locked nucleic acid with 5-methylcytidine base
  modified_base 33: mod_base = OTHER; note = 2'-O-methoxyethyl adenosine
  modified_base 34: mod_base = OTHER; note = Locked nucleic acid with 5-methylcytidine base
  modified_base 35: mod_base = OTHER; note = 2'-O-methoxyethyl adenosine
  modified_base 36: mod_base = OTHER; note = Locked nucleic acid with 5-methylcytidine base
  modified_base 37: mod_base = OTHER; note = 2'-O-methoxyethyl adenosine
  modified_base 38: mod_base = OTHER; note = Locked nucleic acid with 5-methylcytidine base
  modified_base 39: mod_base = OTHER; note = 2'-O-methoxyethyl adenosine
  modified_base 40: mod_base = OTHER; note = Locked nucleic acid with 5-methylcytidine base

SEQ ID NO: 667 - DNA, 3221 bp, Hepatitis B virus
  source 1..3221: mol_type = genomic DNA
ttccactgccttccaccaagcactgcaggatcccagagtcaggggtccgtattttcctgctggtggctccagttcaggaacagtaaaccctgctccgaatattgcctctcacatctcgtcaatctccgcgaggactggggaccctgtgacgaacatggagaacatcacatcaggactcctaggacccctgctcgtgttacaggcggggtttttcttgttgacaagaatcctcacaataccgcagagtctaggctcgtggtggacttctctcaattttctagggggatcacccgtgtgtcttggccaaaattcgcagtccccaacctccaatcactcaccaacctcctgtcctccaatttgtcctggttatcgttggatgtgtctgcggcgttttatcatattcctcttcatcctgctgctatgcctcatcttcttattggttcttctggattatcaaggtatgttgcccgtttgtcctctaattccaggatcaacaacaaccggtacgggaccatgcaaaacctgcacgactcctgctcaaggcaactctatgtttccctcatgttgctgtacaaaacctacggacggaaattgcacctgtattcccatcccatcgtcctgggctttcgcaaaatacctatgggagtgggcctcagtccgtttctcttggctcagtttactagtgccatttgttcagtggttcgtagggctttcccccactgtttggctttcagctatatggatgatgtggtattgggggccaagactgtacagcatcgtgagtccctttataccgctgttaccaattttcttttgtctctgggtatacatttaaaccctaacaaaacaaaaagatggggttattccctaaacttcatgggttacataattggaagttggggaactttgccacaggatcatattgtacaaaagatcaaacactgttttagaaaacttcctgttaacaggcctattgattggaaagtatgtcaaagaattgtgggtcttttgggctttgctgctccatttacacaatgtggatatcctgccttaatgcctttgtatgcatgtatacaagctaaacaggctttcactttctcgccaacttacaaggcctttctaagtaaacagtacatgaacctttaccccgttgctcggcaacggcctggtctgtgccaagtgtttgctgacgcaacccccactggctggggcttggccataggccatcagcgcatgcgtggaacctttgtggctcctctgccgatccatactgcggaactcctagccgcttgttttgctcgcagccggtctggagcaaagctcatcggaactgacaattctgtcgtcctctcgcggaaatatacatcgtttccatggctgctaggctgtactgccaactggatccttcgcgggacgtcctttgtttacgtcccgtcggcgctgaatcccgcggacgacccctctcggggccgcttgggactctatcgtccccttctccgtctgccgttccagccgaccacggggcgcacctctctttacgcggtctccccgtctgtgccttctcatctgccggtccgtgtgcacttcgcttcacctctgcacgttgcatggagaccaccgtgaacgcccatcagatcctgcccaaggtcttacataagaggactcttggactcccagcaatgtcaacgaccgaccttgaggcctacttcaaagactgtgtgtttaaggactgggaggagctgggggaggagagtaggttaatgatctttgtattaggaggctgtaggcataaattggtctgcgcaccagcaccatgcaactttttcacctctgccaaatcatctcttgtacatgtcccactgttcaagcctccaagctgtgccttgggtggctttggggcatggacattgacccttataaagaatttggagctactgttgagttactctcgtttttgccttctgacttctttccttccgtcagagatcttctagacaccgcctcagctctgtatcgagaagccttagagtctcctgagcactgctcacctcaccatactgcactcaggcaagccattctctgctggggggaattgatgactctagctacctgggtgggtaataatttggatgatccagcatccagggatctagtagtcaattatgttaatactaacatgggtttaaagatcaggcaactattgtggtttcatatatcttgccttacttttggaagagagactgtacttgaatatttggtctctttcggagtgtggattcgcactcctccaccctatagaccaccaaatgcccctatcttatcaacacttccggaaactactgttattagacgacgggaccgaggcaggtcccctagaagaagaactccctcgcctcgcagacgcagatctcaatcgccgcgtcgcagaagatctcaatctcgggaatctcaatgttagtattccttggactcataaggtgggaaactttacggggctttattcctctacagtacctatctttaatcctgaatggcaaactccttcctttcctaagattcatttacaagaggacattattaataggtgtcaacaatttgtgggccctctcactgtaaatgaaaagagaagattgaaattaattatgcctgctagattctatcctacccacactaaatatttgcccttagacaaaggaattaaaccttattatccagatcaggtagttaatcattacttccaaaccagacattatttacatactctttggaaggcgggtattctatataagagggaaaccacacgtagcgcatcattttgcgggtcaccatattcttgggaacaagagctacagcatgggaggttggtcatcaaaacctcgcaaaggcatggggacgaatctttctgttcccaaccctctgggattctttcccgatcatcagttggaccctgcattcggagccaactcaaacaatccagattgggacttcaaccccatcaaggaccactggccagcagccaaccaggtgggagtgggggcattcgggccagggctcacccctccacacggcggtatcttggggtggagccctcaggctcagggcatattgaccacagtgtcaacaattcctcctcctgcctccaccaatcggcagtcaggaaggcagcctactcccatctctccacctctccgagacagtcatcctcaggccacgcagtggaa

SEQ ID NO: 668 - DNA, 3215 bp, Hepatitis B virus
  source 1..3215: mol_type = genomic DNA
ctccaccactttccaccaaactcttcaagatcccggagtcagggccctgtactttcctgctggtggctccagttcaggaacagtgagccctgctcagaatactgtctctgccatatcgtcaatcttatcgaagactggggaccctgtaccgaacatggagaacatcgcatcaggactcctaggacccctgctcgtgttacaggcggggtttttcttgttgacaaaaatcctcacaataccacagagtctagactcgtggtggacttctctcaattttctagggggaacacccgtgtgtcttggccaaaattcgcagtcccaaatctccagtcactcaccaacctgttgtcctccaatttgtcctggttatcgctggatgtgtctgcggcgttttatcatcttcctctgcatcctgctgctatgcctcatcttcttgttggttcttctggactatcaaggtatgttgcccgtttgtcctctaattccaggatcatcaacaaccagcaccggaccatgcaaaacctgcacaactcctgctcaaggaacctctatgtttccctcatgttgctgtacaaaacctacggatggaaactgcacctgtattcccatcccatcatcttgggctttcgcaaaatacctatgggagtgggcctcagtccgtttctcttggctcagtttactagtgccatttgttcagtggttcgtagggctttcccccactgtctggctttcagttatatggatgatatggttttgggggccaagtctgtacaacatcttgagtccctttatgccgctgttaccaattttcttttgtctttgggtatacatttaaaccctcacaaaacaaaaagatggggatattcccttaacttcatgggatatgtaattgggagctggggcacattgccacaggaacatattgtacaaaaaatcaaaatgtggtttaggaaacttcctgtaaacaggcctattgattggaaagtatgtcaacgaattgtgggtcttttggggtttgccgcccctttcacgcaatgtggatatcctgctttaatgcctttatatgcatgtatacaagcaaaacaggcttttactttctcgccaacttacaaggcctttctaactaaacagtatctgaacctttaccccgttgctcggcaacggccaggtctgtgccaagtgtttgctgacgcaacccccactggttggggcttggccataggccatcagcgcatgcgtggaacctttgtgtctcctctgccgatccatactgcggaactcctagccgcttgttttgctcgcagccggtctggggcaaaactcatcgggactgacaattctgtcgtgctctcccgcaagtatacatcatttccatggctgctaggctgtgctgccaactggatcctgcgcgggacgtcctttgtttacgtcccgtcggcgctgaatcccgcggacgacccttcccggggccgcttggggctctaccgcccgcttctccgcctgttgtaccgaccgaccacggggcgcacctctctttacgcggactccccgtctgtgccttctcatctgccggaccgtgtgcacttcgcttcacctctgcacgtcgcatggagaccaccgtgaacgcccacgggaacctgcccaaggtcttgcataagaggactcttggactttcagcaatgtcaacgaccgaccttgaggcatacttcaaagactgtgtgtttaatgagtgggaggagttgggggaggaggttaggttaaaggtctttgtactaggaggctgtaggcataaattggtgtgttcaccagcaccatgcaactttttcacctctgcctaatcatctcatgttcatgtcctactgttcaagcctccaagctgtgccttgggtggctttggggcatggacattgacccgtataaagaatttggagcttctgtggagttactctcttttttgccttctgacttctttccgtcggtgcgagatctcctcgacaccgcctctgctttgtatcgggaggccttagagtctccggaacattgttcacctcaccatacggcactcaggcaagctattctgtgttggggtgagttaatgaatctagccacctgggtgggaagtaatttggaagatccggcatccagggaattagtagtcagctatgtcaacgttaatatgggcctaaaaatcagacaactattgtggtttcacatttcctgtcttacttttgggagagaaactgttcttgaatatttggtgtcttttggagtgtggattcgcactcctcctgcatatagaccaccaaatgcccctatcttatcaacacttccggaaactactgttgttagacgaagaggcaggtcccctagaagaagaactccctcgcctcgcagacgaaggtctcaatcgccgcgtcgcagaagatctcaatctcgggaatctcaatgttagtattccttggacacataaggtgggaaactttacggggctttattcttctacggtaccttgctttaatcctaaatggcaaactccttcttttcctgacattcatttgcaggaggacattgttgatagatgtaagcaatttgtggggccccttacagtaaatgaaaacaggagactaaaattaattatgcccgctaggttttatcccaatgttactaaatatttgcccttagataaagggatcaaaccgtattatccagagtatgtagttaatcattacttccagacgcgacattatttacacactctttggaaggcggggatcttatataaaagagagtccacacgtagcgcctcattttgcgggtcaccatattcttgggaacaagatctacagcatgggaggttggtcttccaaacctcgaaaaggcatggggacaaatctttctgtccccaatcctctgggattcttccccgatcatcagttggaccctgcattcaaagccaactcagaaaatccagattgggacctcaacccgaacaaggacaactggccggacgccaacaaggtgggagtgggagcattcgggccagggttcacccctccccatgggggactgttggggtggagccctcaggctcagggcctactcacaactgtgccagcagctcctcctcctgcctccaccaatcggcagtcaggaaggcagcctactcccttatccccacctctaagggacactcatcctcaggccatgcagtggaa

SEQ ID NO: 669 - DNA, 3215 bp, Hepatitis B virus
  source 1..3215: mol_type = genomic DNA
ctccaccacattccaccaagctctgctagatcccagagtgaggggcctatattttcctgctggtggctccagttccggaacagtaaaccctgttccgactactgcctcacccatatcgtcaatcttctcgaggactggggaccctgcacagaacatggagaacacaacatcaggattcctaggacccctgctcgtgttacaggcggggtttttcttgttgacaaaaatcctcacaataccacagagtctagactcgtggtggacttctctcaattttctagggggagcacccacgtgtcctggccaaaattcgcagtccccaacctccaatcactcaccaacctcttgtcctccaatttgtcctggctatcgctggatgtgtctgcggcgttttatcatattcctcttcatcctgctgctatgcctcatcttcttgttggttcttctggactaccaaggtatgttgcccgtttgtcctctacttccaggaacaacaactaccagcacgggaccatgcaagacctgcacgattcctgctcaaggaacctctatgtttccctcttgttgctgtacaaaaccttcggacggaaactgcacttgtattcccatcccatcatcctgggctttcgcaagattcctatgggagtgggcctcagtccgtttctcctggctcagtttactagtgccatttgttcagtggttcgtagggctttcccccactgtttggctttcagttatatggatgatgtggtattgggggccaagtctgtacaacatcttgagtccctttttacctctattaccaattttcttttgtctttgggtatacatttgaatcctaataaaaccaaacgttggggctactcccttaacttcatgggatatgtaattggaagttggggtactttaccacaggaacatattgtacggaaactcaagcaatgttttcgaaaactgcctgtaaatagacctattgattggaaagtatgtcaaagaattgtgggtcttttgggctttgctgccccttttacacaatgtggctatcctgccttgatgcctttatatgcatgtatacactctaagcaggctttcactttctcgccaacttacaaggcctttctgtgtaaacaatatctgcacctttaccccgttgcccggcaacggtcaggtctctgccaagtgtttgctgacgcaacccccactggatggggcttggccataggccatcggcgcatgcgcggaacctttgtggctcctctgccgatccatactgcggaactcctagcagcttgttttgctcgcagccggtctggagcaaaacttatcgggactgacaactctgttgtcctctctcggaaatacacctccttcccatggctgctcgggtgtgctgccaactggatccttcgcgggacgtcctttgtctacgtcccgtcggcgctgaatcccgcggacgacccgtctcggggccgtttggggctctatcgtccccttcttcatctgccgttccggccgaccacggggcgcacctctctttacgcggtctccccgtctgtgccttctcatctgccggaccgtgtgcacttcgcttcacctctgcacgtcgcatggagaccaccgtgaacgcccaccaggtcttgcccaaggtcttacataagaggactcttggactctcatcaatgtcaacgaccgaccttgaggcatacttcaaagactgtttgtttaaggactgggaggagttgggggaggagattaggttaaaggtctttgtactaggaggctgtaggcataaattggtctgttcaccagcaccatgcaactttttcacctctgcctaatcatctcatgttcatgtcctactgttcaagcctccaagctgtgccttgggtggctttggggcatggacattgacccgtataaagaatttggagcttctgtggagttactctcttttttgccttctgacttctttccttctattcgagatctcctcgacaccgcctctgctctgtatcgggaggccttagagtctccggaacattgttcacctcaccatacagcactcaggcaagctattctgtgttggggtgagttgatgaatctggccacctgggtgggaagtaatttggaagacccagcatccagggaattagtagtcagctatgtcaatgttaatatgggcctaaaaatcagacaactattgtggtttcacatttcctgtcttacttttggaagagaaactgttcttgagtatttggtatcttttggagtgtggattcgcactcctccagcttacagaccaccaaatgcccctatcttatcaacacttccggaaactactgttgttagacgacgaggcaggtcccctagaagaagaactccctcgcctcgcagacgaaggtctcaatcgccgcgtcgcagaagatctcaatctcgggaatctcaatgttagtatcccttggactcataaggtgggaaactttactgggctttattcttctactgtacctgtctttaatcctgagtggcaaactccctcctttcctaacattcatttacaggaggacattattaatagatgtgaacaatatgtgggccctcttacaactaatgaaaaaaggagattaaaattaattatgcctgctaggttttatcctaaccttaccaaatacttgcccttggataaaggcattaaaccttattatcctgaacatgcagttaatcattacttcaaaactaggcattatttacatactctgtggaaggccggcattctatataagagagaaactacacgcagcgcttcattttgtgggtcaccatattcttgggaacaagagctacagcatgggaggttggtcttccaaacctcgacaaggcatggggacgaatctttctgttcccaatcctctgggattttttcccgatcaccagttggaccctgcgttcggagccaactcaaacaatccagattgggacttcaaccccaacaaggatcactggccagaggcaaatcaggtaggagcgggagcattcgggccagggttcaccccaccacacggcggtcttttggggtggagccctcaggctcagggcatattgaccacagtgccagcagcgcctcctcctgcctccaccaatcggcagtcaggaagacagcctactcccatctctccacctctaagagacagtcatcctcaggccatgcagtggaa

SEQ ID NO: 670 - DNA, 10123 bp, Hepatitis B virus
  source 1..10123: mol_type = genomic DNA
aaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgggccactccctctctgcgcgctcgctcgctcactgaggccgcccgggctttgcccgggcggcctcagtgagcgagcgagcgcgcagagagggagtggccaactccatcactaggggttcctctgctcgatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtggaattccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcccctaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggacagatccccaggaagctcctctgtgtcctcataaaccctaacctcctctacttgagaggacattccaatcataggctgcccatccaccctctgtgtcctcctgttaattaggtcacttaacaaaaaggaaattgggtaggggtttttcacagaccgctttctaagggtaattttaaaatatctgggaagtcccttccactgctgtgttccagaagtgttggtaaacagcccacaaatgtcaacagcagaaacatacaagctgtcagctttgcacaagggcccaacaccctgctcatcaagaagcactgtggttgctgtgttagtaatgtgcaaaacaggaggcacattttccccacctgtgtaggttccaaaatatctagtgttttcatttttacttggatcaggaacccagcactccactggataagcattatccttatccaaaacagccttgtggtcagtgttcatctgctgactgtcaactgtagcattttttggggttacagtttgagcaggatatttggtcctgtagtttgctaacacaccctgcagctccaaaggttccccaccaacagcaaaaaaatgaaaatttgacccttgaatgggttttccagcaccattttcatgagttttttgtgtccctgaatgcaagtttaacatagcagttaccccaataacctcagttttaacagtaacagcttcccacatcaaaatatttccacaggttaagtcctcatttaaattaggcaaaggaattaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatcgatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgcttta

SEQ ID NO: 671 - DNA, 3212 bp, Hepatitis B virus
  source 1..3212: mol_type = genomic DNA
ttccacaacattccaccaagctctgcaggatcccagagtaagaggcctgtattttcctgctggtggctccagttccggaacagtgaaccctgttccgactactgcctcactcatctcgtcaatcttctcgaggattggggaccctgcaccgaacatggaaagcatcacatcaggattcctaggacccctgctcgtgttacaggcggggtttttcttgttgacaaaaatcctcacaataccgcagagtctagactcgtggtggacttctctcaattttctagggggagctcccgtgtgtcttggccaaaattcgcagtccccaacctccaatcactcaccaacctcttgtcctccaatttgtcctggctatcgctggatgtgtctgcggcgttttatcatcttcctcttcatcctgctgctatgcctcatcttcttgttggttcttctggactatcaaggtatgttgcccgtttgtcctctaattccaggatcatcaaccaccagtacgggaccctgccgaacctgcacgactcttgctcaaggaacctctatgtttccctcatgttgctgttcaaaaccttcggacggaaattgcacttgtattcccatcccatcatcatgggctttcggaaaattcctatgggagtgggcctcagcccgtttctcctggctcagtttactagtgccatttgttcagtggttcgccgggctttcccccactgtctggctttcagttatatggatgatgtggtattgggggccaagtctgtacaacatcttgagtccctttatacctctgttaccaattttcttttgtctttgggtatacatttaaatcccaacaaaacaaaaagatggggatattccctaaatttcatgggttatgtaattggaagttgggggtcattaccacaggaacacatcagaatgaaaatcaaagactgttttagaaaactccctgttaaccggcctattgattggaaagtatgtcaaagaattgtgggtcttttgggctttgctgccccttttacacaatgtggatatcctgctttaatgcctctgtatgcgtgtattcaatctaagcaggctttcactttctcgccaacttacaaggcctttctgtgtaaacaatacctgaacctttaccccgttgcccggcaacggccaggtctgtgccaagtgtttgctgatgcaacccccactggctggggcttggccataggccatcagcgcatgcgtggaacctttgtggctcctctgccgatccatactgcggaactcctagccgcttgttttgctcgcagcaggtctggagcgaaacttatcgggacagataattctgtcgttctctcccggaaatatacatcatttccatggctgctaggctgtgctgccaactggatcctgcgagggacgtcctttgtctacgtcccgtcagcgctgaatcctgcggacgacccgtctcggggtcgcttggggatctatcgtccccttctccgtctgccgttccagccgaccacggggcgcacctctctttacgcggtctccccgtctgtgccttctcatctgccggaccgtgtgcacttcgcttcacctctgcacgtcgcatggagaccaccgtgaacgcccaccaaatcttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacattgacccttataaagaatttggagctactgtggagttactctcgtttttgccttctgacttctttccttcagtaagagatcttctagataccgcctcagctctgtatcgggatgccttagaatctcctgagcattgttcacctcaccacactgcactcaggcaagccattctttgctggggggaactaatgactctagctacctgggtgggtgtaaatttggaagatccagcatccagggacctagtagtcagttatgtcaatactaatatgggcctaaagttcaggcaattattgtggtttcacatttcttgtctcacttttggaagagaaaccgtcatagagtatttggtgtcttttggagtgtggattcgcactcctccagcttatagaccaccaaatgcccctatcttatcaacacttccggagaatactgttgttagacgaagaggcaggtcccctagaagaagaactccctcgcctcgcagacgaagatctcaatcgccgcgtcgcagaagatctcaatctccagcttcccaatgttagtattccttggactcacaaggtgggaaattttacggggctttactcttctactatacctgtctttaatcctaactggaaaactccatcttttcctgatattcatttgcaccaggacattattaacaaatgtgaacaatttgtaggtcctctaacagtaaatgaaaaacgaagattaaacttagtcatgcctgctagattttttcccatctctacgaaatatttgcccctagagaaaggtataaaaccttattatccagataatgtagttaatcattacttccaaaccagacactatttacataccctatggaaggcgggcatcttatataaaagagaaactacacgtagcgcctcattttgtgggtcaccttattcttgggaacaagagctacatcatggggctttcttggacggtccctctcgaatgggggaagaatcattccaccaccaatcctctgggattttttcccgaccaccagttggatccagcattcagagcaaacaccagaaatccagattgggaccacaatcccaacaaagaccactggacagaagccaacaaggtaggagtgggagcattcgggccggggttcactcccccacacggaggccttttggggtggagccctcaggctcaaggcatgctaaaaacattgccagcagatccgcctcctgcctccaccaatcggcagtcaggaaggcagcctaccccaatcactccacctttgagagacactcatcctcaggccatgcagtggaa

SEQ ID NO: 672 - DNA, 3215 bp, Hepatitis B virus
  source 1..3215: mol_type = genomic DNA
ctcaactcagttccaccaggctctgttggatccgagggtaagggctctgtattttcctgctggtggctccagttcagggacacagaaccctgctccgactattgcctctctcacatcatcaatcttctcgaagactgggggccctgccatgaacatggagaacatcacatcaggactcctaggacccctgctcgtgttacaggcggtgtgtttcttgttgacaaaaatcctcacaataccacagagtctagactcgtggtggacttctctcaattttctagggggactacccgggtgtcctggccaaaattcgcagtccccaacctccaatcacttaccaacctcctgtcctccaacttgtcctggctatcgttggatgtgtctgcggcgttttatcatcttcctcttcatcctgctgctatgcctcatcttcttgttggttcttctggactaccaaggtatgttgcccgtttgtcctctacttccaggatccacgaccaccagcacgggaccatgcaaaacctgcacaactcttgctcaaggaacctctatgtttccctcctgttgctgttccaaaccctcggacggaaactgcacctgtattcccatcccatcatcttgggctttaggaaaatacctatgggagtgggcctcagcccgtttctcctggctcagtttactagtgcaatttgttcagtggtgcgtagggctttcccccactgtctggcttttagttatatggatgatctggtattgggggccaaatctgtgcagcatcttgagtccctttataccgctgttaccaattttctgttatctgtgggtatccatttaaatactgctaaaacaaaaagatggggttactccctacatttcatgggttatgttattggtagttggggaacgttaccccaagatcatattgtacacaaaatcaaagattgttttcggaaacttcctgtaaatcgtccaattgattggaaagtttgtcaacgcattgtgggtcttttgggctttgcggcccctttcacccaatgtggttatcctgctctcatgcctttgtatacctgtattactgctaaacaggcgtttgtcttttcgccaacttacaaggcctttctctgtaaacaatacatgaacctttaccccgttgctcggcaacggccaggcctgtgccaagtgtttgctgacgcaacccccactggttggggcttggccattggccatcagcgcatgcgtggaacctttgtggctcctctgccgatccatactgcggaactccttgcagcctgtttcgctcgcagccggtctggagcgaacattatcggcacagacaactctgttgtcctctctaggaagtacacctcctttccatggctgctcggttgtgctgccaactggatcctgcgcgggacgtcctttgtttacgtcccgtcggcgctgaatcccgcggacgacccctcccggggtcgcttggggctgtaccgcccccttcttcgtctgccgttccagccgacaacgggtcgtacctctctttacgcggactccccgtctgttccttctcatctgccggaccgtgtgcacttcgcttcacctctgcacgtcgcatggagaccaccgtgaacgccccctggaatctgccaacagtcttacataagaggactcttggactttcaggacggtcaatgacctggatcgaagactacatcaaagactgtgtatttaaggactgggaggagctgggggaggagatcacgttaaaggtctttgtactaggaggctgtaggcataaattggtctgtgcaccagcaccatgcaactttttcacctctgcctaatcatcttttgttcatgtcccactgttcaagcctccaagctgtgccttgggtggctttggggcatggacattgacccttataaagaatttggagcttctgtggaattgctctcttttttgccttctgatttcttcccgtctgttcgggacctactcgacaccgcttcagccctgtaccgggatgctctagagtcaccggaacattgcacccccaatcataccgctctcaggcaagctattttgtgctggggtgagttaatgactttggcttcctgggtgggtaataatttggaagaccctgcagctagggatttagtagttaattatgtcaacactaatatgggcctaaaaattagacaactgttgtggtttcacatttcctgtcttacttttggaagagaaacagttcttgagtatttggtgtcctttggagtgtggattcgcactccacctgcttatagaccaccaaatgcccctatcctatccacacttccggaaactactgttgttagacgacgaggcaggtcccctagaagaagaactccctcgcctcgccgacgaaggtctcaatcgccgcgtcgcagaagatctcaatctccagcttcccaatgttagtattccttggactcataaggtgggaaattttacggggctctactcttctactgtacctgctttcaatcctaactggttaactccttcttttcctgatattcatttacatcaggatctgatatctaaatgtgaacaatttgtaggcccgctcactaaaaatgaattgagaagattaaaattggtcatgccagctagattttatcctaaggttaccaaatactttcctatggagaaagggattaaaccctattatcctgagcatgcagttaatcattattttaaaacaagacattatttgcatactttatggaaggcgggaatcttatataagagagaatccacacgtagcgcctcattttgtgggtcaccatattcctgggaacaagagctacagcatgggagcacctctctcaacgacaagaaggggcatgggactgaatctttctgtgcccaatcctctgggcttcttgccagaccatcagctggatccgctattcagagcaaattccagcagtcccgactgggacttcaacacaaacaaggacagttggccaatggcaaacaaggtaggagtgggaggctacggtccagggttcacacccccacacggtggcctgctggggtggagccctcaggcacagggtgttttaacaaccttgccagcagatccgcctcctgcttccaccaatcggcggtccgggagaaagccaaccccagtctctccacctctaagagacacacatccacaggccatgcagtggaa

SEQ ID NO: 673 - DNA, 3248 bp, Hepatitis B virus
  source 1..3248: mol_type = genomic DNA
ctctacagcattccaccaagctctacaaaatcccaaagtcaggggcctgtattttcctgctggtggctccagttcagggatagtgaaccctgttccgactattgcctctcacatctcgtcaatcttctccaggattggggaccctgcaccgaacatggagaacatcacatcaggattcctaggacccctgctcgtgttacaggcggggtttttcttgttgacaagaatcctcacaataccgcagagtctagactcgtggtggacttctctcaattttctagggggagtgcccgtgtgtcctggcctaaattcgcagtccccaacctccaatcactcaccaatctcctgtcctccaacttgtcctggctatcgctggatgtgtctgcggcgttttatcatattcctcttcatcctgctgctatgcctcatcttcttgttggttcttctggactatcaaggtatgttgcccgtttgtcctctgattccaggatcctcgaccaccagtacgggaccctgcaaaacctgcacgactcctgctcaaggcaactctatgtatccctcatgttgctgtacaaaaccttcggacggaaattgcacctgtattcccatcccatcatcttgggctttcgcaaaatacctatgggagtgggcctcagtccgtttctcttggctcagtttactagtgccatttgttcagtggttcgtagggctttcccccactgtctggctttcagctatatggatgatgtggtattgggggccaaatctgtacaacatcttgagtccctttataccgctgttaccaattttcttttgtctttgggtatacatctaaaccctaacaaaacaaaaagatggggttattccttaaattttatgggatatgtaattggaagttggggtactttgccacaagaacacatcacacagaaaattaagcaatgttttcggaaactccctgttaacaggccaattgattggaaagtctgtcaacgaataactggtctgttgggtttcgctgctccttttacccaatgtggttaccctgccttaatgcctttatatgcatgtatacaagctaagcaggcttttactttctcgccaacttataaggcctttctctgtaaacaatacatgaacctttaccccgttgctaggcaacggcccggtctgtgccaagtgtttgctgacgcaacccccactggttggggcttggccatcggccatcagcgcatgcgtggaacctttgtggctcctctgccgatccatactgcggaactcctagctgcttgttttgctcgcagccggtctggagcaaaactcattgggactgacaattctgtcgtcctttctcggaaatatacatcctttccatggctgctaggctgtgctgccaactggatccttcgcgggacgtcctttgtttacgtcccgtcagcgctgaatccagcggacgacccctcccggggccgtttggggctctgtcgcccccttctccgtctgccgttcctgccgaccacggggcgcacctctctttacgcggtctccccgtctgttccttctcatctgccggaccgtgtgcacttcgcttcacctctgcacgttacatggaaaccgccatgaacacctctcatcatctgccaaggcagttatataagaggactcttggactgtttgttatgtcaacaaccggggtggagaaatacttcaaggactgtgtttttgctgagtgggaagaattaggcaatgagtccaggttaatgacctttgtattaggaggctgtaggcataaattggtctgcgcaccagcaccatgtaactttttcacctctgcctaatcatctcttgttcatgtcctactgttcaagcctccaagctgtgccttgggtggctttagggcatggatagaacaactttgccatatggcctttttggcttagacattgacccttataaagaatttggagctactgtggagttgctctcgtttttgccttctgactttttcccgtctgttcgtgatcttctcgacaccgcttcagctttgtaccgggaatccttagagtcctctgatcattgttcgcctcaccatacagcactcaggcaagcaatcctgtgctggggtgagttgatgactctagctacctgggtgggtaataatttggaagatccagcatccagagatttggtggtcaattatgttaatactaatatgggtttaaaaatcaggcaactattgtggtttcacatttcctgtcttacttttgggagagaaaccgttcttgagtatttggtgtcttttggagtgtggattcgcactcctcctgcttatagaccaccaaatgcccctatcctatcaacacttccggagactactgttgttagacgaagaggcaggtcccctcgaagaagaactccctcgcctcgcagacgaagatctcaatcgccgcgtcgcagaagatctgcatctccagcttcccaatgttagtattccttggactcacaaggtgggaaactttacggggctgtattcttctactatacctgtctttaatcctgattggcaaactccttcttttccaaatatccatttgcatcaagacattataactaaatgtgaacaatttgtgggccctctcacagtaaatgagaaacgaagattaaaactagttatgcctgccagatttttcccaaactctactaaatatttaccattagacaaaggtatcaaaccgtattatccagaaaatgtagttaatcattacttccagaccagacattatttacataccctttggaaggcgggtattctatataagagagaaacatcccgtagcgcttcattttgtgggtcaccatatacttgggaacaagatctacagcatggggctttcttggacggtccctctcgagtggggaaagaacctttccaccagcaatcctctaggattccttcccgatcaccagttggacccagcattcagagcaaataccaacaatccagattgggacttcaatcccaaaaaggacccttggccagaggccaacaaggtaggagttggagcctatggacccgggttcacccctccacacggaggccttttggggtggagccctcagtctcagggcacactaacaactttgccagcagatccgcctcctgcctccaccaatcgtcagtcagggaggcagcctactcccatctctccaccactaagagacagtcatcctcaggccatgcagtggaa

SEQ ID NO: 674 - DNA, 3215 bp, Hepatitis B virus
  source 1..3215: mol_type = genomic DNA
ctcaacacagttccaccaagcactgttggatccgagagtaaggggtctgtattttcctgctggtggctccagttcagaaacacagaaccctgctccgactattgcctctctcacatcatcaatcttctcgaagactggggaccctgctatgaacatggagaacatcacatcaggactcctaggaccccttctcgtgttacaggcggtgtgtttcttgttgacaaaaatcctcacaataccacagagtctagactcgtggtggacttctctcaattttctaggggtaccacccgggtgtcctggccaaaattcgcagtccccaatctccaatcacttaccaacctcctgtcctccaacttgtcctggctatcgttggatgtgtctgcggcgttttatcatcttcctcttcatcctgctgctatgcctcatcttcttgttggttcttctggactatcaaggtatgttgcccgtgtgtcctctacttccaggatctacaaccaccagcacgggaccctgcaaaacctgcaccactcttgctcaaggaacctctatgtttccctcctgctgctgtaccaaaccttcggacggaaattgcacctgtattcccatcccatcatcttgggctttcggaaaatacctatgggagtgggcctcagcccgtttctcttggctcagtttactagtgcaatttgttcagtggtgcgtagggctttcccccactgtctggcttttagttatatggatgatttggtattgggggccaaatctgtgcagcatcttgagtccctttataccgctgttaccaattttttgttatctgtgggcatccatttgaacacagctaaaacaaaatggtggggttattccttacactttatgggttatataattgggagttgggggaccttgcctcaggaacatattgtgcataaaatcaaagattgctttcgcaaacttcccgtgaatagacccattgattggaaggtttgtcaacgcattgtgggtcttttgggctttgcagccccttttactcaatgtggttatcctgctctcatgcccttgtatgcctgtattaccgctaagcaggcttttgttttctcgccaacttacaaggcctttctctgtaaacaatacatgaacctttaccccgttgctcggcaacggccaggcctttgccaagtgtttgctgacgcaacccccactggctggggcttggcgattggccatcagcgcatgcgcggaacctttgtggctcctctgccgatccatactgcggaactcctagcagcttgtttcgctcgcagcaggtctggagcggacattatcggcactgacaactccgttgtcctttctcggaagtacacctccttcccatggctgctaggctgtgctgccaactggatcctgcgcgggacgtcctttgtctacgtcccgtcggcgctgaatcctgcggacgacccctctcgtggtcgcttggggctctgccgccctcttctccgcctgccgttccggccgacgacgggtcgcacctctctttacgcggactccccgcctgtgccttctcatctgccggcccgtgtgcacttcgcttcacctctgcacgtcgcatggagaccaccgtgaacgccccttggaacttgccaacaaccttacataagaggactcttggactttcgccccggtcaacgacctggattgaggaatacatcaaagactgtgtatttaaggactgggaggagtcgggggaggagttgaggttaaaggtctttgtattaggaggctgtaggcataaattggtctgttcaccagcaccatgcaactttttcacctctgcctaatcatcttttgttcatgtcccactgttcaagcctccaagctgtgccttgggtggctttggggcatggacattgacccttataaagaatttggagcttctgtggagttactctcatttttgccttctgacttcttcccgtctgtccgggacctactcgacaccgcttcagccctctaccgagatgccttagaatcacccgaacattgcacccccaaccacactgctctcaggcaagctattttgtgctggggtgagttgatgaccttggcttcctgggtgggcaataatttagaggatcctgcagcaagagatctagtagttaattatgtcaatactaacatgggcctaaaaattagacaattattatggtttcacatttcctgccttacatttggaagagaaactgtgcttgagtatttggtgtcttttggagtgtggattcgcactccacctgcttatagaccaccaaatgcccctatcctatcaacacttccggagactactgttgttagacaacgaggcagggcccctagaagaagaactccctcgcctcgcagacgaagatctcaatcaccgcgtcgcagaagatctcaatctccagcttcccaatgttagtattccttggactcataaggtgggaaactttaccggtctttactcctctactatacctgttttcaatcctgactggttaactccttcttttcctgacattcacttgcatcaagatctgatacaaaaatgtgaacaatttgtaggcccactcactacaaatgaaaggagacgattgaaactaattatgccagctaggttttatcccaaagttactaaatacttccctttggataaaggtattaagccttactatccagagaatgtggttaatcattactttaaaactagacattatttacatactttgtggaaggcaggaattctatataagagagaatccacacatagcgcctcattttgtgggtcaccatattcctgggaacaagagctacagcatgggagcacctctctcaacggcgagaaggggcatgggacagaatctttctgtgcccaatcctctgggattctttccagaccaccagttggatccactattcagagcaaattccagcagtcccgattgggacttcaacacaaacaaggacaattggccaatggcaaacaaggtaggagtgggaggcttcggtccagggttcacacccccacacggtggccttctggggtggagccctcaggcacagggcattctgacaacctcgccaccagatccacctcctgcttccaccaatcggaggtcaggaagaaagccaaccccagtctctccacctctaagggacacacatccacaggccatgcagtggaa

SEQ ID NO: 675 - DNA, 20 bp, Hepatitis B virus
  source 1..20: mol_type = genomic DNA
tttgtttacgtcccgtcggc

SEQ ID NO: 676 - DNA, 30 bp, Hepatitis B virus
  source 1..30: mol_type = genomic DNA
tttacgtcccgtcggcgctgaatcctgcgg

SEQ ID NO: 677 - DNA, 20 bp, Hepatitis B virus
  source 1..20: mol_type = genomic DNA
tttacgtcccgtcggcgctg

SEQ ID NO: 678 - DNA, 20 bp, Hepatitis B virus
  source 1..20: mol_type = genomic DNA
tttacgcggactccccgtct

SEQ ID NO: 679 - DNA, 20 bp, Hepatitis B virus
  source 1..20: mol_type = genomic DNA
ttgtttacgtcccgtcggcg

SEQ ID NO: 680 - DNA, 20 bp, Hepatitis B virus
  source 1..20: mol_type = genomic DNA
ttgttgacaagaatcctcac

SEQ ID NO: 681 - DNA, 19 bp, Hepatitis B virus
  source 1..19: mol_type = genomic DNA
ttgagagaagtccaccacg

SEQ ID NO: 682 - DNA, 30 bp, Hepatitis B virus
  source 1..30: mol_type = genomic DNA
ttctcctggctcagtttactagtgccattt

SEQ ID NO: 683 - DNA, 20 bp, Hepatitis B virus
  source 1..20: mol_type = genomic DNA
ttctcctggctcagtttact

SEQ ID NO: 684 - DNA, 20 bp, Hepatitis B virus
  source 1..20: mol_type = genomic DNA
ttacgtcccgtcggcgctga

SEQ ID NO: 685 - DNA, 20 bp, Hepatitis B virus
  source 1..20: mol_type = genomic DNA
tgtttacgtcccgtcggcgc

SEQ ID NO: 686 - DNA, 20 bp, Hepatitis B virus
  source 1..20: mol_type = genomic DNA
tgtgccttctcatctgccgg

SEQ ID NO: 687 - DNA, 20 bp, Hepatitis B virus
  source 1..20: mol_type = genomic DNA
tgtgcacttcgcttcacctc

SEQ ID NO: 688 - DNA, 20 bp, Hepatitis B virus
  source 1..20: mol_type = genomic DNA
tggtggacttctctcaattt

SEQ ID NO: 689 - DNA, 20 bp, Hepatitis B virus
  source 1..20: mol_type = genomic DNA
tggctcagtttactagtgcc

SEQ ID NO: 690 - DNA, 25 bp, Hepatitis B virus
  source 1..25: mol_type = genomic DNA
tggacttctctcaattttctagggg

SEQ ID NO: 691 - DNA, 20 bp, Hepatitis B virus
  source 1..20: mol_type = genomic DNA
tggacttctctcaattttct

SEQ ID NO: 692 - DNA, 20 bp, Hepatitis B virus
  source 1..20: mol_type = genomic DNA
tgccttctcatctgccggac

SEQ ID NO: 693 - DNA, 20 bp, Hepatitis B virus
  source 1..20: mol_type = genomic DNA
tgccggaccgtgtgcacttc

SEQ ID NO: 694 - DNA, 20 bp, Hepatitis B virus
  source 1..20: mol_type = genomic DNA
tgccgatccatactgcggaa

SEQ ID NO: 695 - DNA, 20 bp, Hepatitis B virus
  source 1..20: mol_type = genomic DNA
tgcacttcgcttcacctctg

SEQ ID NO: 696 - DNA, 20 bp, Hepatitis B virus
  source 1..20: mol_type = genomic DNA
tgacaagaatcctcacaata

SEQ ID NO: 697 - DNA, 20 bp, Hepatitis B virus
  source 1..20: mol_type = genomic DNA
tctttacgcggactccccgt

SEQ ID NO: 698 - DNA, 20 bp, Hepatitis B virus
  source 1..20: mol_type = genomic DNA
tcttgttgacaagaatcctc

SEQ ID NO: 699 - DNA, 20 bp, Hepatitis B virus
  source 1..20: mol_type = genomic DNA
tctgtgccttctcatctgcc

SEQ ID NO: 700 - DNA, 20 bp, Hepatitis B virus
  source 1..20: mol_type = genomic DNA
tctgccgatccatactgcgg

SEQ ID NO: 701 - DNA, 20 bp, Hepatitis B virus
  source 1..20: mol_type = genomic DNA
tctctttacgcggactcccc

SEQ ID NO: 702 - DNA, 20 bp, Hepatitis B virus
  source 1..20: mol_type = genomic DNA
tctcatctgccggaccgtgt

SEQ ID NO: 703 - DNA, 20 bp, Hepatitis B virus
  source 1..20: mol_type = genomic DNA
tcggcgctgaatcctgcgga

SEQ ID NO: 704 - DNA, 20 bp, Hepatitis B virus
  source 1..20: mol_type = genomic DNA
tcctggctcagtttactagt

SEQ ID NO: 705 - DNA, 20 bp, Hepatitis B virus
  source 1..20: mol_type = genomic DNA
tcctcacaataccgcagagt

SEQ ID NO: 706 - DNA, 20 bp, Hepatitis B virus
  source 1..20: mol_type = genomic DNA
tcccgtcggcgctgaatcct

SEQ ID NO: 707 - DNA, 20 bp, Hepatitis B virus
  source 1..20: mol_type = genomic DNA
tccatactgcggaactccta

SEQ ID NO: 708 - DNA, 20 bp, Hepatitis B virus
  source 1..20: mol_type = genomic DNA
tcatctgccggaccgtgtgc

SEQ ID NO: 709 - DNA, 22 bp, Hepatitis B virus
  source 1..22: mol_type = genomic DNA
tcatctcgaacgttcacagtca

SEQ ID NO: 710 - DNA, 20 bp, Hepatitis B virus
  source 1..20: mol_type = genomic DNA
tcagtttactagtgccattt

SEQ ID NO: 711 - DNA, 20 bp, Hepatitis B virus
  source 1..20: mol_type = genomic DNA
tattgtgaggattcttgtca

SEQ ID NO: 712 - DNA, 30 bp, Hepatitis B virus
  source 1..30: mol_type = genomic DNA
taggaggctgtaggcataaattggtctgcg

SEQ ID NO: 713 - DNA, 20 bp, Hepatitis B virus
  source 1..20: mol_type = genomic DNA
tacgtcccgtcggcgctgaa

SEQ ID NO: 714 - DNA, 20 bp, Hepatitis B virus
  source 1..20: mol_type = genomic DNA
tacgcggactccccgtctgt

SEQ ID NO: 715 - DNA, 20 bp, Hepatitis B virus
  source 1..20: mol_type = genomic DNA
gtttacgtcccgtcggcgct

SEQ ID NO: 716 - DNA, 20 bp, Hepatitis B virus
  source 1..20: mol_type = genomic DNA
gttggtgcacttcgcttcac

SEQ ID NO: 717 - DNA, 20 bp, Hepatitis B virus
  source 1..20: mol_type = genomic DNA
gttgacaagaatcctcacaa

SEQ ID NO: 718 - DNA, 19 bp, Hepatitis B virus
  source 1..19: mol_type = genomic DNA
gttcccagtatggatcggc

SEQ ID NO: 719 - DNA, 20 bp, Hepatitis B virus
  source 1..20: mol_type = genomic DNA
gtgtgcacttcgcttcacct

SEQ ID NO: 720 - DNA, 20 bp, Hepatitis B virus
  source 1..20: mol_type = genomic DNA
gtggtggacttctctcaatt

SEQ ID NO: 721 - DNA, 21 bp, Hepatitis B virus
  source 1..21: mol_type = genomic DNA
gtggacttctctcaattttct

SEQ ID NO: 722 - DNA, 20 bp, Hepatitis B virus
  source 1..20: mol_type = genomic DNA
gtggacttctctcaattttc

SEQ ID NO: 723 - DNA, 20 bp, Hepatitis B virus
  source 1..20: mol_type = genomic DNA
gtgccttctcatctgccgga

SEQ ID NO: 724 - DNA, 20 bp, Hepatitis B virus
  source 1..20: mol_type = genomic DNA
gtgcacttcgcttcacctct

SEQ ID NO: 725 - DNA, 20 bp, Hepatitis B virus
  source 1..20: mol_type = genomic DNA
gtgaagcgaagtgcacacgg

SEQ ID NO: 726 - DNA, 20 bp, Hepatitis B virus
  source 1..20: mol_type = genomic DNA
gtctgtgccttctcatctgc

SEQ ID NO: 727 - DNA, 20 bp, Hepatitis B virus
  source 1..20: mol_type = genomic DNA
gtcggcgctgaatcctgcgg

SEQ ID NO: 728 - DNA, 20 bp, Hepatitis B virus
  source 1..20: mol_type = genomic DNA
gtcccgtcggcgctgaatcc

SEQ ID NO: 729 - DNA, 20 bp, Hepatitis B virus
  source 1..20: mol_type = genomic DNA
gtattgtgaggattcttgtc

SEQ ID NO: 730 - DNA, 20 bp, Hepatitis B virus
  source 1..20: mol_type = genomic DNA
ggtggacttctctcaatttt

SEQ ID NO: 731 - DNA, 20 bp, Hepatitis B virus
  source 1..20: mol_type = genomic DNA
gggcgcacctctctttacgc

SEQ ID NO: 732 - DNA, 20 bp, Hepatitis B virus
  source 1..20: mol_type = genomic DNA
ggctgtaggcataaattggt

SEQ ID NO: 733 - DNA, 20 bp, Hepatitis B virus
  source 1..20: mol_type = genomic DNA
ggcgctgaatcctgcggacg

SEQ ID NO: 734 - DNA, 20 bp, Hepatitis B virus
  source 1..20: mol_type = genomic DNA
ggaggaaccttcagggaagg

SEQ ID NO: 735 - DNA, 20 bp, Hepatitis B virus
  source 1..20: mol_type = genomic DNA
ggactccccgtctgtgcctt

SEQ ID NO: 736 - DNA, 20 bp, Hepatitis B virus
  source 1..20: mol_type = genomic DNA
ggaccgtgtgcacttcgctt

SEQ ID NO: 737 - DNA, 19 bp, Hepatitis B virus
  source 1..19: mol_type = genomic DNA
gctgtaggcataaattggt

SEQ ID NO: 738 - DNA, 20 bp, Hepatitis B virus
  source 1..20: mol_type = genomic DNA
gctgaatcctgcggacgacc

SEQ ID NO: 739 - DNA, 20 bp, Hepatitis B virus
  source 1..20: mol_type = genomic DNA
gctcagtttactagtgccat

SEQ ID NO: 740 - DNA, 20 bp, Hepatitis B virus
  source 1..20: mol_type = genomic DNA
gcggactccccgtctgtgcc

SEQ ID NO: 741 - DNA, 20 bp, Hepatitis B virus
  source 1..20: mol_type = genomic DNA
gcgctgaatcctgcggacga

SEQ ID NO: 742 - DNA, 20 bp, Hepatitis B virus
  source 1..20: mol_type = genomic DNA
gcgcacctctctttacgcgg

SEQ ID NO: 743 - DNA, 20 bp, Hepatitis B virus
  source 1..20: mol_type = genomic DNA
gccttctcatctgccggacc

SEQ ID NO: 744 - DNA, 20 bp, Hepatitis B virus
  source 1..20: mol_type = genomic DNA
gccggaccgtgtgcacttcg

SEQ ID NO: 745 - DNA, 20 bp, Hepatitis B virus
  source 1..20: mol_type = genomic DNA
gccgatccatactgcggaac

SEQ ID NO: 746 - DNA, 19 bp, Hepatitis B virus
  source 1..19: mol_type = genomic DNA
gccgatccatactgcggaa

SEQ ID NO: 747 - DNA, 20 bp, Hepatitis B virus
  source 1..20: mol_type = genomic DNA
gcacttcgcttcacctctgc

SEQ ID NO: 748 - DNA, 20 bp, Hepatitis B virus
  source 1..20: mol_type = genomic DNA
gcactagtaaactgagccag

SEQ ID NO: 749 - DNA, 20 bp, Hepatitis B virus
  source 1..20: mol_type = genomic DNA
gcacctctctttacgcggac

SEQ ID NO: 750 - DNA, 20 bp, Hepatitis B virus
  source 1..20: mol_type = genomic DNA
gatccatactgcggaactcc

SEQ ID NO: 751 - DNA, 20 bp, Hepatitis B virus
  source 1..20: mol_type = genomic DNA
gactccccgtctgtgccttc

SEQ ID NO: 752 - DNA, 20 bp, Hepatitis B virus
  source 1..20: mol_type = genomic DNA
gaccgtgtgcacttcgcttc

SEQ ID NO: 753 - DNA, 20 bp, Hepatitis B virus
  source 1..20: mol_type = genomic DNA
gacaagaatcctcacaatac

SEQ ID NO: 754 - DNA, 20 bp, Hepatitis B virus
  source 1..20: mol_type = genomic DNA
gaatcctcacaataccgcag

SEQ ID NO: 755 - DNA, 20 bp, Hepatitis B virus
  source 1..20: mol_type = genomic DNA
gaaaattgagagaagtccac

SEQ ID NO: 756 - DNA, 20 bp, Hepatitis B virus
  source 1..20: mol_type = genomic DNA
ctttgtttacgtcccgtcgg

SEQ ID NO: 757 - DNA, 30 bp, Hepatitis B virus
  source 1..30: mol_type = genomic DNA
cttgttgacaagaatcctcacaataccgca

SEQ ID NO: 758 - DNA, 20 bp, Hepatitis B virus
  source 1..20: mol_type = genomic DNA
cttctcatctgccggaccgt

SEQ ID NO: 759 - DNA, 20 bp, Hepatitis B virus
  source 1..20: mol_type = genomic DNA
ctgtgccttctcatctgccg

SEQ ID NO: 760 - DNA, 20 bp, Hepatitis B virus
  source 1..20: mol_type = genomic DNA
ctggctcagtttactagtgc

SEQ ID NO: 761 - DNA, 19 bp, Hepatitis B virus
  source 1..19: mol_type = genomic DNA
ctggctcagtttactagtg

SEQ ID NO: 762 - DNA, 20 bp, Hepatitis B virus
  source 1..20: mol_type = genomic DNA
ctgccggaccgtgtgcactt

SEQ ID NO: 763 - DNA, 20 bp, Hepatitis B virus
  source 1..20: mol_type = genomic DNA
ctgccgatccatactgcgga

SEQ ID NO: 764 - DNA, 20 bp, Hepatitis B virus
  source 1..20: mol_type = genomic DNA
ctctgccgatccatactgcg

SEQ ID NO: 765 - DNA, 20 bp, Hepatitis B virus
  source 1..20: mol_type = genomic DNA
ctcctggctcagtttactag

SEQ ID NO: 766 - DNA, 20 bp, Hepatitis B virus
  source 1..20: mol_type = genomic DNA
ctccccgtctgtgccttctc

SEQ ID NO: 767 - DNA, 20 bp, Hepatitis B virus
  source 1..20: mol_type = genomic DNA
ctcacaataccgcagagtct

SEQ ID NO: 768 - DNA, 30 bp, Hepatitis B virus
  source 1..30: mol_type = genomic DNA
ctatcaaggtatgttgcccgtttgtcctct

SEQ ID NO: 769 - DNA, 20 bp, Hepatitis B virus
  source 1..20: mol_type = genomic DNA
cgtgtgcacttcgcttcacc

SEQ ID NO: 770 - DNA, 30 bp, Hepatitis B virus
  source 1..30: mol_type = genomic DNA
cgtggtggacttctctcaattttctagggg

SEQ ID NO: 771 - DNA, 25 bp, Hepatitis B virus
  source 1..25: mol_type = genomic DNA
cgtggtggacttctctcaattttct

SEQ ID NO: 772 - DNA, 20 bp, Hepatitis B virus
  source 1..20: mol_type = genomic DNA
cgtggtggacttctctcaat

SEQ ID NO: 773 - DNA, 20 bp, Hepatitis B virus
  source 1..20: mol_type = genomic DNA
cgtggtggacttctctcaat

SEQ ID NO: 774 - DNA, 20 bp, Hepatitis B virus
  source 1..20: mol_type = genomic DNA
cgtcggcgctgaatcctgcg

SEQ ID NO: 775 - DNA, 20 bp, Hepatitis B virus
  source 1..20: mol_type = genomic DNA
cgtcccgtcggcgctgaatc

SEQ ID NO: 776 - DNA, 20 bp, Hepatitis B virus
  source 1..20: mol_type = genomic DNA
cggggcgcacctctctttac

SEQ ID NO: 777 - DNA, 20 bp, Hepatitis B virus
  source 1..20: mol_type = genomic DNA
cggcgctgaatcctgcggac

SEQ ID NO: 778 - DNA, 20 bp, Hepatitis B virus
  source 1..20: mol_type = genomic DNA
cggactccccgtctgtgcct

SEQ ID NO: 779 - DNA, 20 bp, Hepatitis B virus
  source 1..20: mol_type = genomic DNA
cggaccgtgtgcacttcgct

SEQ ID NO: 780 - DNA, 20 bp, Hepatitis B virus
  source 1..20: mol_type = genomic DNA
cgctgaatcctgcggacgac

SEQ ID NO: 781 - DNA, 20 bp, Hepatitis B virus
  source 1..20: mol_type = genomic DNA
cgcggactccccgtctgtgc

SEQ ID NO: 782 - DNA, 20 bp, Hepatitis B virus
  source 1..20: mol_type = genomic DNA
cgcacctctctttacgcgga

SEQ ID NO: 783 - DNA, 20 bp, Hepatitis B virus
  source 1..20: mol_type = genomic DNA
cctttgtttacgtcccgtcg

SEQ ID NO: 784 - DNA, 20 bp, Hepatitis B virus
  source 1..20: mol_type = genomic DNA
ccttctcatctgccggaccg

SEQ ID NO: 785 - DNA, 20 bp, Hepatitis B virus
  source 1..20: mol_type = genomic DNA
ccttaggcactcctgcctct

SEQ ID NO: 786 - DNA, 20 bp, Hepatitis B virus
  source 1..20: mol_type = genomic DNA
cctggctcagtttactagtg

SEQ ID NO: 787 - DNA, 30 bp, Hepatitis B virus
  source 1..30: mol_type = genomic DNA
cctctgccgatccatactgcggaactccta

SEQ ID NO: 788 - DNA, 20 bp, Hepatitis B virus
  source 1..20: mol_type = genomic DNA
cctctgccgatccatactgc

SEQ ID NO: 789 - DNA, 20 bp, Hepatitis B virus
  source 1..20: mol_type = genomic DNA
cctctctttacgcggactcc

SEQ ID NO: 790 - DNA, 20 bp, Hepatitis B virus
  source 1..20: mol_type = genomic DNA
cctcacaataccgcagagtc

SEQ ID NO: 791 - DNA, 20 bp, Hepatitis B virus
  source 1..20: mol_type = genomic DNA
ccgtgtgcacttcgcttcac

SEQ ID NO: 792 - DNA, 20 bp, Hepatitis B virus
  source 1..20: mol_type = genomic DNA
ccgtgtgcacttcgctgttg

SEQ ID NO: 793 - DNA, 16 bp, Hepatitis B virus
  source 1..16: mol_type = genomic DNA
ccgtgtgcacttcgct

SEQ ID NO: 794 - DNA, 20 bp, Hepatitis B virus
  source 1..20: mol_type = genomic DNA
ccgtctgtgccttctcatct

SEQ ID NO: 795 - DNA, 20 bp, Hepatitis B virus
  source 1..20: mol_type = genomic DNA
ccgtcggcgctgaatcctgc

SEQ ID NO: 796 - DNA, 20 bp, Hepatitis B virus
  source 1..20: mol_type = genomic DNA
ccggtccgtgtgcacttcgc

SEQ ID NO: 797 - DNA, 20 bp, Hepatitis B virus
  source 1..20: mol_type = genomic DNA
ccggaccgtgtgcacttcgc

SEQ ID NO: 798 - DNA, 20 bp, Hepatitis B virus
  source 1..20: mol_type = genomic DNA
ccgatccatactgcggaact

SEQ ID NO: 799 - DNA, 20 bp, Hepatitis B virus
  source 1..20: mol_type = genomic DNA
cccgtcggcgctgaatcctg

SEQ ID NO: 800 - DNA, 20 bp, Hepatitis B virus
  source 1..20: mol_type = genomic DNA
ccccgtctgtgccttctcat

SEQ ID NO: 801 - DNA, 20 bp, Hepatitis B virus
  source 1..20: mol_type = genomic DNA
caggtcccctagaagaagaa

SEQ ID NO: 802 - DNA, 20 bp, Hepatitis B virus
  source 1..20: mol_type = genomic DNA
cacggggcgcacctctcttt

SEQ ID NO: 803 - DNA, 20 bp, Hepatitis B virus
  source 1..20: mol_type = genomic DNA
cacctctctttacgcggact

SEQ ID NO: 804 - DNA, 20 bp, Hepatitis B virus
  source 1..20: mol_type = genomic DNA
caagaatcctcacaataccg

SEQ ID NO: 805 - DNA, 20 bp, Hepatitis B virus
  source 1..20: mol_type = genomic DNA
atctgccggaccgtgtgcac

SEQ ID NO: 806 - DNA, 20 bp, Hepatitis B virus
  source 1..20: mol_type = genomic DNA
atcctcacaataccgcagag

SEQ ID NO: 807 - DNA, 30 bp, Hepatitis B virus
  source 1..30: mol_type = genomic DNA
agactcgtggtggacttctctcaattttct

SEQ ID NO: 808 - DNA, 20 bp, Hepatitis B virus
  source 1..20: mol_type = genomic DNA
agaatcctcacaataccgca

SEQ ID NO: 809 - DNA, 20 bp, Hepatitis B virus
  source 1..20: mol_type = genomic DNA
acgtcccgtcggcgctgaat

SEQ ID NO: 810 - DNA, 20 bp, Hepatitis B virus
  source 1..20: mol_type = genomic DNA
acgcggactccccgtctgtg

SEQ ID NO: 811 - DNA, 20 bp, Hepatitis B virus
  source 1..20: mol_type = genomic DNA
acctctctttacgcggactc

SEQ ID NO: 812 - DNA, 20 bp, Hepatitis B virus
  source 1..20: mol_type = genomic DNA
accgtgtgcacttcgcttca

SEQ ID NO: 813 - DNA, 20 bp, Hepatitis B virus
  source 1..20: mol_type = genomic DNA
accaatttatgcctacagcg

SEQ ID NO: 814 - DNA, 20 bp, Hepatitis B virus
  source 1..20: mol_type = genomic DNA
acaagaatcctcacaatacc

SEQ ID NO: 815 - DNA, 20 bp, Hepatitis B virus
  source 1..20: mol_type = genomic DNA
aatcctcacaataccgcaga

SEQ ID NO: 816 - DNA, 20 bp, Hepatitis B virus
  source 1..20: mol_type = genomic DNA
aaggtatgttgcccgtttgt

SEQ ID NO: 817 - DNA, 20 bp, Hepatitis B virus
  source 1..20: mol_type = genomic DNA
aagaatcctcacaataccgc

SEQ ID NO: 818 - skipped

SEQ ID NO: 819 - DNA, 20 bp, Hepatitis B virus
  source 1..20: mol_type = genomic DNA
ctagactcgtggtggacttc

SEQ ID NO: 820 - DNA, 20 bp, Hepatitis B virus
  source 1..20: mol_type = genomic DNA
cctgctgctatgcctcatct

SEQ ID NO: 821 - DNA, 20 bp, Hepatitis B virus
  source 1..20: mol_type = genomic DNA
ctgctgctatgcctcatctt

SEQ ID NO: 822 - DNA, 20 bp, Hepatitis B virus
  source 1..20: mol_type = genomic DNA
tgctgctatgcctcatcttc

SEQ ID NO: 823 - DNA, 20 bp, Hepatitis B virus
  source 1..20: mol_type = genomic DNA
gctgctatgcctcatcttct

SEQ ID NO: 824 - DNA, 20 bp, Hepatitis B virus
  source 1..20: mol_type = genomic DNA
ctgctatgcctcatcttctt

SEQ ID NO: 825 - DNA, 20 bp, Hepatitis B virus
  source 1..20: mol_type = genomic DNA
cctatgggagtgggcctcag

SEQ ID NO: 826 - DNA, 20 bp, Hepatitis B virus
  source 1..20: mol_type = genomic DNA
gccatttgttcagtggttcg

SEQ ID NO: 827 - DNA, 20 bp, Hepatitis B virus
  source 1..20: mol_type = genomic DNA
ggaggctgtaggcataaatt

SEQ ID NO: 828 - DNA, 20 bp, Hepatitis B virus
  source 1..20: mol_type = genomic DNA
gaggctgtaggcataaattg

SEQ ID NO: 829 - DNA, 20 bp, Hepatitis B virus
  source 1..20: mol_type = genomic DNA
aggctgtaggcataaattgg

SEQ ID NO: 830 - DNA, 20 bp, Hepatitis B virus
  source 1..20: mol_type = genomic DNA
ggctgtaggcataaattggt

SEQ ID NO: 831 - DNA, 20 bp, Hepatitis B virus
  source 1..20: mol_type = genomic DNA
ttcaagcctccaagctgtgc

SEQ ID NO: 832 - DNA, 20 bp, Hepatitis B virus
  source 1..20: mol_type = genomic DNA
tcaagcctccaagctgtgcc

SEQ ID NO: 833 - DNA, 20 bp, Hepatitis B virus
  source 1..20: mol_type = genomic DNA
caagcctccaagctgtgcct

SEQ ID NO: 834 - DNA, 20 bp, Hepatitis B virus
  source 1..20: mol_type = genomic DNA
aagcctccaagctgtgcctt

SEQ ID NO: 835 - DNA, 20 bp, Hepatitis B virus
  source 1..20: mol_type = genomic DNA
agcctccaagctgtgccttg

SEQ ID NO: 836 - DNA, 20 bp, Hepatitis B virus
  source 1..20: mol_type = genomic DNA
gcctccaagctgtgccttgg

SEQ ID NO: 837 - DNA, 20 bp, Hepatitis B virus
  source 1..20: mol_type = genomic DNA
gaactccctcgcctcgcaga

SEQ ID NO: 838 - DNA, 19 bp, Hepatitis B virus
  source 1..19: mol_type = genomic DNA
caccatattcttgggaaca

What is claimed is:

1. A modified oligonucleotide complementary to a portion of a Hepatitis B virus (HBV) genome, wherein the modified oligonucleotide comprises SEQ ID NO: 456 .

2. The modified oligonucleotide of claim 1, wherein at least one internucleoside linkage is a phosphodiester linkage.

3. The modified oligonucleotide of claim 1, wherein the modified oligonucleotide is linked to a conjugate group.

4. The modified oligonucleotide of claim 1, wherein the modified oligonucleotide is linked to a stabilizing group.

5. The modified oligonucleotide of claim 1, wherein at least one internucleoside linkage is a modified internucleoside linkage.

6. The modified oligonucleotide of claim 5, wherein the modified internucleoside linkage is a phosphorothioate internucleoside linkage.

7. The modified oligonucleotide of claim 1, wherein each internucleoside linkage is a phosphorothioate internucleoside linkage.

* * * * *